United States Patent 10,767,156 (POLYNUCLEOTIDES ENCODING BREX SYSTEM POLYPEPTIDES AND METHODS OF USING SAME) - sequence listing, part 8

SEQ ID NO: 6219 - DNA, 4643538 bp, Escherichia coli (residues 1-1,547,846 of 4,643,538)
agcttttcattctgactgcaacgggcaatatgtctctgtgtggattaaaaaaagagtgtctgatagcagcttctgaactggttacctgccgtgagtaaattaaaattttattgacttaggtcactaaatactttaaccaatataggcatagcgcacagacagataaaaattacagagtacacaacatccatgaaacgcattagcaccaccattaccaccaccatcaccattaccacaggtaacggtgcgggctgacgcgtacaggaaacacagaaaaaagcccgcacctgacagtgcgggcttttttttcgaccaaaggtaacgaggtaacaaccatgcgagtgttgaagttcggcggtacatcagtggcaaatgcagaacgttttctgcgggttgccgatattctggaaagcaatgccaggcaggggcaggtggccaccgtcctctctgcccccgccaaaatcaccaaccacctggtggcgatgattgaaaaaaccattagcggccaggatgctttacccaatatcagcgatgccgaacgtatttttgccgaacttctgacgggactcaccgccgcccagccgggattcccgctggcgcaactgaaaactttcgtcgaccaggaatttgcccaaataaaacatgtcctgcatggcattagtttgttggggcagtgcccggatagcatcaacgctgcgctgatttgccgtggcgagaaaatgtcgatcgccattatggccggcgtgttagaagcgcgtggtcacaacgttaccgttatcgatccggtcgaaaaactactggcagtggggcattacctcgaatctaccgtcgatattgctgagtccacccgccgtattgcggcaagtcgtattccggctgatcacatggtgctgatggcaggcttcaccgccggtaatgaaaaaggcgaactggtggtacttggacgcaacggttccgactactccgcggcggtgctggctgcctgtttacgcgccgattgttgcgagatttggacggacgttgacggggtctatacctgcgacccgcgtcaggtgcccgatgcgaggttgttgaagtcgatgtcctaccaggaagcgatggagctttcctacttcggcgctaaagttcttcacccccgcaccattacccccatcgcccagttccagatcccttgcctgattaaaaataccggaaatcctcaagcaccaggtacgctcattggtgccagccgtgatgaagacgaattaccggtcaagggcatttccaatctgaataacatggcaatgttcagcgtttctggtccgggaatgaaagggatggtcggcatggcggcgcgcgtctttgcagcgatgtcacgcgcccgtatttccgtggtgctgattacgcaatcatcttccgaatacagtatcagtttctgcgttccgcaaagcgactgtgtgcgagctgaacgggcaatgcaggaagagttctacctggaactgaaagaaggcttactggagccgctggcggtgacggaacggctggccattatctcggtggtaggtgatggtatgcgcaccttgcgtgggatctcggcgaaattctttgccgcgctggcccgcgccaatatcaacattgtcgccattgctcagggatcttctgaacgctcaatctctgtcgtggtaaataacgatgatgcgaccactggcgtgcgcgttactcatcagatgctgttcaataccgatcaggttatcgaagtgtttgtgattggcgtcggtggcgttggcggtgcgctgctggagcaactgaagcgtcaacaaagctggctgaagaataaacatatcgacttacgtgtctgcggtgttgccaactcgaaggcactgctcaccaatgtgcatggcctaaatctggaaaactggcaggaagaactggcgcaagccaaagagccgtttaatctcgggcgcttaattcgcctcgtgaaagaatatcatctgctgaacccggtcattgttgactgcacctccagccaggcagtggcggatcaatatgccgacttcttgcgcgaaggtttccacgttgtcacgccgaacaaaaaggccaacacctcgtcgatggattactaccatctgttgcgtcatgcggcggaaaaatcgcggcgtaaattcctctatgacaccaacgttggggctggattaccggttattgagaacctgcaaaatctgctcaatgctggtgatgaattgatgaagttctccggcattctttcaggttcgctttcttatatcttcggcaagttagacgaaggcatgagtttctccgaggcgactactctggcgcgggaaatgggttataccgaaccggatccgcgagatgatctttctggtatggatgtagcgcgtaagctattgattctcgctcgtgaaacgggacgtgaactggagctggcggatattgaaattgaacctgtgctgcccgcagagtttaacgctgagggtgatgttgccgcttttatggcgaatctgtcacagctcgacgatctctttgccgcgcgcgtggcgaaggcccgtgatgaaggaaaagttttgcgctatgttggcaatattgatgaagatggtgcctgccgcgtgaagattgccgaagtggatggtaatgatccgctgttcaaagtgaaaaatggcgaaaacgccctggccttttatagccactattatcagccgctgccgttggtgctgcgcggatatggtgcgggcaatgacgttacagctgccggtgtctttgccgatctgctacgtaccctctcatggaagttaggagtctgacatggttaaagtttatgccccggcttccagtgccaatatgagcgtcgggtttgatgtgctcggggcggcggtgacacctgttgatggtgcattgctcggagatgtagtcacggttgaggcggcagagacattcagtctcaacaacctcggacgctttgccgataagctgccgtcagaaccacgggaaaatatcgtttatcagtgctgggagcgtttttgccaggagcttggcaagcaaattccagtggcgatgactctggaaaagaatatgccaatcggttcgggcttaggctccagcgcctgttcggtggtcgcggcgctgatggcgatgaatgaacactgtggcaagccgcttaatgacactcgtttgctggctttgatgggcgagctggaaggacgaatctccggcagcattcattacgacaacgtggcaccgtgttttcttggtggtatgcagttgatgatcgaagaaaacgacatcatcagccagcaagtgccagggtttgatgagtggctgtgggtgctggcgtatccggggattaaagtctcgacggcagaagccagggctattttaccggcgcagtatcgccgccaggattgcattgcgcacgggcgacatctggctggcttcattcacgcctgctattcccgtcagcctgagcttgccgcgaagctgatgaaagatgttatcgctgaaccctaccgtgaacggttactgcctggcttccggcaggcgcggcaggcggtcgcggaaatcggcgcggtagcgagcggtatctccggctccggcccgaccttgttcgctctatgtgacaagccggataccgcccagcgcgttgccgactggttgggtaagaactacctgcaaaatcaggaaggttttgttcatatttgccggctggatacggcgggcgcacgagtactggaaaactaaatgaaactctacaatctgaaagatcacaacgagcaggtcagctttgcgcaagccgtaacccaggggttgggcaaaaatcaggggctgttttttccgcatgacctgccggaattcagcctgactgaaattgatgagatgctgaagctggattttgtcacccgcagtgcgaagatcctctcggcgtttattggtgatgaaatcccgcaggaaatcctggaagagcgcgtgcgcgcggcgtttgccttcccggctccggtcgccaatgttgaaagcgatgtcggttgtctggaattgttccacgggccaacgctggcatttaaagatttcggcggtcgctttatggcacaaatgctgacccatattgcgggcgataagccagtgaccattctgaccgcgacctccggtgataccggagcggcagtggctcatgctttctacggtttaccgaatgtgaaagtggttatcctctatccacgaggcaaaatcagtccactgcaagaaaaactgttctgtacgttgggcggcaatatcgaaactgttgccatcgacggcgatttcgatgcctgtcaggcgctggtgaagcaggcgtttgatgatgaagaactgaaagtggcgctggggttaaactcagctaactcgattaacatcagccgtttgctggcgcagatttgctactactttgaagctgttgcgcagctgccgcaggaagcgcgcaaccagctggttgtctcggtgccaagcggaaacttcggcgatttgacggcgggtctgctggcgaagtcactcggtctgccggtgaaacgttttattgctgcgaccaacgtgaacgataccgtgccacgtttcctgcacgacggtcagtggtcacccaaagcgactcaggcgacgttatccaacgcgatggacgtgagtcagccgaacaactggccgcgtgtggaagagttgttccgccgcaaaatctggcaactgaaagagctgggttatgcagccgttgatgatgaaaccacgcaacagacaatgcgtgagttaaaagaactgggctacacctcggagccgcacgctgccgtagcgtatcgtgcgctgcgtgaccagttgaatccaggcgaatatggcttgttcctcggcaccgcgcatccggcgaaatttaaagagagcgtggaagcgattctcggtgaaacgttggatctgccaaaagagctggcagaacgtgctgatttacccttgctttcacataatctgcccgccgattttactgcgttgcgtaaattgatgatgaatcatcagtaaaatctattcattatctcaatcaggccgggtttgcttttatgcagcccggcttttttatgaagaaattatggagaaaaacgacagggaaaaaggagaaattctcaataaatgcggtaacttagagattaggattgcggagaataacaaccgtcgttctcatcgcgtaatctccggatatcgacccataacgggcaatgataaaaggagtaacctgtgaaaaagatgcaatctatcgtactcgcactttccctggttctggtcgctcccatggcagcacaggctgcggaaattacgttagtcccgtcagtaaaattacagataggcgatcgtgataatcgtggctattactgggatggaggtcactggcgcgaccacggctggtggaaacaacattatgaatggcgaggcaatcgctggcacccacacggaccgccgccaccgccgcgccaccataagaaagctcctcatgatcatcacggcggtcatggtccaggcaaacatcaccgctaaatgacaaatgccgggtaacaatccggcattcagcgcctgatgcgacgctggcgcgtcttatcaggcctacgtgaattctgcaatatattgaatctgcatgcttttgtaggccggataaggcgttcacgccgcatccggcattgactacaaacttaacgctgctcgtagcgtttaaacaccagttcgccattgctggaggaagcttcatcaaagaagtaaccttcgctattaaaaccagtcagttgctctggtttggtcagccgattttcaataataaaacgactcatcagaccgcgtgctttcttagcgtagaagctgattatcttaaatttgccgttcttctcatcgaggaacaccggcttgataatctcggcattcaatttcttcggcttcaccgatttaaaatactcatctgacgccagattaatcaccacattatcgccttgtgctgcgagcgcctcgttcagcttgttggtgatgatatctccccagaattgatacagatctttccctcgggcattctcaagacggatccccatttccagacgataaggctgcattaaatcgagcgggcgcagtacgccatacaagccggaaagcattcgcaaatgctgttgggcaaaatcgaaatcgtcttcgctgaaggtttcggcctgcaagccggtgtagacatcacctttaaacgccagaatcgcctggcgggcattctccggcgtgaaatctggctgccagtcatgaaagcgagcggcgttgatacccgccagtttgtcgctgatgcgcatcagcgtgctaatctgcggaggcgtcagtttccgcgcttcatggatcaactgctgggaattgtctaacagctccggcagcgtatagcgcgtggtggtcaacgggctttggtaatcaagcgttttcgcaggtgaaataagaatcagcatatccagtccttgcaggaaatttatgccgactttagcaaaaaaagagaatgagttgatcgatagttgtgattactcctgcgaaacatcatcccacgcgtccggagaaagctggcgaccgatatccggataacgcaacggatcaaacaccgggcgcacgccgagtttacgctggcgtagataatcactggcaatggtatgaaccacaggcgagagcagtaaaatggcggtcaaattggtaatagccatgcaggccattatgatatctgccagttgccacatcagcggaagacttagcaaggtgccgccgatgaccgttgcgaaggtgcagatccgcaaacaccagatcgctttagggttgttcaggcgtaaaaagaagagattgttttcggcataaatgtagttggcaacgatggagctgaaggcaaacagaataaccacgagggtaacaaactcagcaccccaggaacccattagcacccgcatcgccttctggataagctgaataccttccagcggcatgtaggttgtgtcgttacccgccagtaatatcagcatggcgcttgccgtacagatgaccagggtgtcgataaaaatgccaatcatctggacaatcccttgcgctgccggatgcggaggccaggacgccgctgccgctgccgcgtttggcgtcgaacccattcccgcctcattggaaaacatactgcgctgaaaaccgttagtaatcgcctggcttaaggtatatcccgccgcgccgcctgccgcttcctgccagccaaaagcactctcaaaaatagaccaaatgacgtggggaagttgcccgatatttattacgcaaatcaccatgctggtcagcacccagattatcgccatcaacgggacaaacccctgcatgagccgagcgacgccatgaagaccgcgagtgattgccagcagagcaaagacagcgagaataatgcctgtcaccagcggaggaaaatcaaaagaaaaacttagggcgcgggcaacggcgttcgcctgaactccgctgaaaattatgccataggcgatgagcaaaaagacggcgaacagaacgcccatccaacgcatccccagcccgcgcgccatataccatgccggtccgccacgaaactgtccattgacgtcacgttctttataaagttgtgccagagaacattcggcaaacgaggtcgccatgccgataaacgcggcaacccacatccaaaagacggctccaggtccaccggcggtaattgccagcgcaacgccggccaggttgccgctacccacgcgcgccgcaagactggtacacaatgactgaaatgaggttaaaccgcctggctgtggatgaatgctatttttaagacttttgccaaactggcggatgtagcgaaactgcacaaatccggtgcgaaaagtgaaccaacaacctgcgccgaagagcaggtaaatcattaccgatccccaaaggacgctgttaataaaggagaaaaaatctggcatgcatatccctcttattgccggtcgcgatgactttcctgtgtaaacgttaccaattgtttaagaagtatatacgctacgaggtacttgataacttctgcgtagcatacatgaggttttgtataaaaatggcgggcgatatcaacgcagtgtcagaaatccgaaacagtctcgcctggcgataaccgtcttgtcggcggttgcgctgacgttgcgtcgtgatatcatcagggcagaccggttacatccccctaacaagctgtttaaagagaaatactatcatgacggacaaattgacctcccttcgtcagtacaccaccgtagtggccgacactggggacatcgcggcaatgaagctgtatcaaccgcaggatgccacaaccaacccttctctcattcttaacgcagcgcagattccggaataccgtaagttgattgatgatgctgtcgcctgggcgaaacagcagagcaacgatcgcgcgcagcagatcgtggacgcgaccgacaaactggcagtaaatattggtctggaaatcctgaaactggttccgggccgtatctcaactgaagttgatgcgcgtctttcctatgacaccgaagcgtcaattgcgaaagcaaaacgcctgatcaaactctacaacgatgctggtattagcaacgatcgtattctgatcaaactggcttctacctggcagggtatccgtgctgcagaacagctggaaaaagaaggcatcaactgtaacctgaccctgctgttctccttcgctcaggctcgtgcttgtgcggaagcaggcgtgttcctgatctcgccatttgttggccgtattcttgactggtacaaagcgaatactgataagaaagagtacgctccggcagaagatccgggcgtggtttctgtatctgaaatctaccagtactacaaagagcacggttatgaaaccgtggttatgggcgcaagcttccgtaacatcggcgaaattctggaactggcaggctgcgaccgtcttaccatcgcacctacactgctgaaagagctggctgagagcgaaggggctatcgaacgtaaactgtcttacaccggcgaagtgaaagcgcgtccggcgcgtatcactgagtccgagttcctgtggcagcacaaccaggatccaatggcagtagataaactggcggaaggtatccgtaagtttgctattgaccaggaaaaactggaaaaaatgatcggcgatctgctgtaatcattcttagcgtgaccgggaagtcggtcacgctacctcttctgaagcctgtctgtcactcccttcgcagtgtatcattctgtttaacgagactgtttaaacggaaaaatcttgatgaatactttacgtattggcttagtttccatctctgatcgcgcatccagcggcgtttatcaggataaaggcatccctgcgctggaagaatggctgacatcggcgctaaccacgccgtttgaactggaaacccgcttaatccccgatgagcaggcgatcatcgagcaaacgttgtgtgagctagtggatgaaatgagttgccatctggtgctcaccacgggcggaactggcccggcgcgtcgtgacgtaacgcccgatgcgacgctggcagtagcggaccgcgagatgcctggctttggtgaacagatgcgccagataagcctgcattttgtaccaactgcgatcctttcgcgtcaggttggtgtgattcgcaaacaggcgctgatccttaacttacccggtcagccgaagtctattaaagagacgctggaaggtgtgaaggacgctgcgggtaacgttgtggtacacggtatttttgccagcgtaccgtactgcattcagttgctggaagggccatacgttgaaacggcaccggaagtggttgcagcattcagaccgaagagtgcaagacgcgacgttagcgaataaaaaaatccccccgagcggggggatctcaaaacaattagtgggattcaccaatcggcagaacggtgcgaccaaactgctcgttcagtacttcacccatcgccagatagattgcgctggcaccgcagatcagcccaatccagccggcaaagtggatgattgcggcgttaccggcaatgttaccgatcgccagcagggcaaacagcacggtcaggctaaagaaaacgaattgcagaacgcgtgcgcctttcagcgtgccgaagaacataaacagcgtaaatacgccccacagacccaggtagacaccaaggaactgtgcatttggcgcatcggtcagacccagtttcggcatcagcagaatcgcaaccagcgtcagccagaaagaaccgtaagaggtgaatgcggttaaaccgaaagtgttgccttttttgtactccagcagaccagcaaaaatttgcgcgatgccgccgtagaaaatgcccatggcaagaataataccgtccagagcgaaataacccacgttgtgcaggttaagcagaatggtggtcatgccgaagcccatcaggcccagcggtgccggattagccaacttagtgttgcccataattcctcaaaaatcatcatcgaatgaatggtgaaataatttccctgaataactgtagtgttttcagggcgcggcataataatcagccagtggggcagtgtctacgatcttttgaggggaaaatgaaaattttccccggtttacggtatcagacctgagtggcgctaaccatccggcgcaggcaggcgatttgcagtacggctggaatcgtcacgcgataggcgctgccgctgaccgctttaaccccatttagtgccgcacctacagggcctcccagccccgcgccgcgcagcaaaccatgcccaagtacgctcattgctgcgtgggtgcgtaaaatgcgggtcagttggctggaaagcaaatgcgacacgccttttgccaataatttgtctttcatcagcagcggcagcagctcttccagctcattcaccctcgcatcgaccgcgtgcagaaactcctgtttatgttcctcgtccatattcttccaggtgttacgcagaaattgttccagtaactgttgctcaatctcaaacgtagacatctctttgtcggctttcagcttcaatcgttttgaaacatcgagcaaaatggcccgatacaatttaccgtgtccgcgcagtttgttggcgatactatcgccaccaaaatgctgtaattctccagcaatcagctgccagttgcggcgatgttgctcgggatgcccttccatcgatttaaacagttcgttgcgcatcagtacgctggagaggcgagttttgcctttttcattatgggtgagcaatcgggcgaaatttgccaactgttcctcactgcaatgctggagaaaatccagatctgaatcattcaggtaattaacattcattttttgtggcttctatattctggcgttagtcgtcgccgataattttcagcgtggccatatccgatgagttcaccgtatgaccggaaaaggtgatttttgagacgcagcgtttattgtcgttatcgctgttaatgttgatccagtcagtggtttgcccttcttttatttctgaaggaatattcaggctctgactggcgctacgggcggctttgaaataaaccgatgcaccgcttaactgtaaatcgccatggtcggcagagagttgtatgcgtttaacaattcggcaaacaggaagtttcagcgccagatcgttggtttcgttacgtggcatcgcaatgacgccgaggattttatggtcgtttgcctgcgccgtgcagcacagcatcagactaatcgccaggctggcggaaatcgtaaaaacggatttcataaggattctcttagtggggagaggtagggggatggatacccactagtttactgctgataaagagaagattcaggtgcgtaatgttttctttttattacaattttttgatgaatgtcttggctgcgattcattctttatatgaataaaattgctgtcagtttcacgtcttgtcctgctatatcgcgaaatttctgcgcaaaagcacaaaaaatttttgcatctcccccttgatgacgtgggttacgaccccatttagtagtcaaccgcagtgagtgagtctgcaaaaaaatgaaattgggcagttgaaaccagacgtttcgcccctattacagactcacaaccacatgatgaccgaatatatagtggagacgtttagatgggtaaaataattggtatcgacctgggtactaccaactcttgtgtagcgattatggatggcaccactcctcgcgtgctggagaacgccgaaggcgatcgcaccacgccttctatcattgcctatacccaggatggtgaaactctggttggtcagccggctaaacgtcaggcagtgacgaacccgcaaaacaccctgtttgcgattaaacgcctgattggccgccgcttccaggacgaagaagtacagcgtgatgtttccatcatgccgttcaaaattattgctgctgataacggcgacgcatgggtcgaagttaaaggccagaaaatggcaccgccgcagatctctgctgaagtgctgaaaaaaatgaagaaaaccgctgaagattacttgggtgaaccggtaactgaagctgttatcaccgtaccggcatactttaacgatgctcagcgtcaggcaaccaaagacgcaggccgtatcgctggtctggaagtaaaacgtatcatcaacgaaccgaccgcagctgcgctggcttacggtctggacaaaggtactggcaaccgtactatcgcggtttatgacctgggtggtggtactttcgatatttctattatcgaaatcgacgaagttgacggcgaaaaaaccttcgaagttctggctaccaacggtgatacccacctgggtggtgaagacttcgacagccgtctgatcaactacctggttgaagaattcaagaaagatcagggcattgacctgcgcaacgatccgctggcaatgcagcgcctgaaagaagcggcagaaaaagcgaaaatcgaactgtcttccgctcagcagaccgacgttaacctgccgtacatcactgcagatgcgaccggtccgaaacacatgaacatcaaagtgactcgtgcgaaactggaaagcctggttgaagatctggtaaaccgttccattgagccgctgaaagttgcactgcaggacgctggcctgtccgtatctgatatcgacgacgttatcctcgttggtggtcagactcgtatgccaatggttcagaagaaagttgctgagttctttggtaaagagccgcgtaaagacgttaacccggacgaagctgtagcaatcggtgctgctgttcagggtggtgttctgactggtgacgtgaaagacgtactgctgctggacgttaccccgctgtctctgggtatcgaaaccatgggcggtgtgatgacgacgctgatcgcgaaaaacaccactatcccgaccaagcacagccaggtgttctctaccgctgaagacaaccagtctgcggtaaccatccatgtgctgcagggtgaacgtaaacgtgcggctgataacaaatctctgggtcagttcaacctggatggtatcaacccggcaccgcgcggcatgccgcagatcgaagttaccttcgatatcgatgctgacggtatcctgcacgtttccgcgaaagataaaaacagcggtaaagagcagaagatcaccatcaaggcttcttctggtctgaacgaagatgaaatccagaaaatggtacgcgacgcagaagctaacgccgaagctgaccgtaagtttgaagagctggtacagactcgcaaccagggcgaccatctgctgcacagcacccgtaagcaggttgaagaagcaggcgacaaactgccggctgacgacaaaactgctatcgagtctgcactgactgcactggaaactgctctgaaaggtgaagacaaagcctctatcgaagcgaaaatgcaggagctggcacaggtttcccagaaactgatggaaatcgcccagcagcaacatgcccagcagcagactgccggtgctgatgcttctgcaaacaacgcgaaagatgacgatgttgtcgacgctgaatttgaagaagtcaaagacaaaaaataatcgccctataaacgggtaattatactgacacgggcgaaggggaatttcctctccgcccgtgcattcatctaggggcaatttaaaaaagatggctaagcaagattattacgagattttaggcgtttccaaaacagcggaagagcgtgaaatcaaaaaggcctacaaacgcctggccatgaaataccacccggaccgtaaccagggtgacaaagaggccgaggcgaaatttaaagagatcaaggaagcttatgaagttctgaccgactcgcaaaaacgtgcggcatacgatcagtatggtcatgctgcgtttgagcaaggcggtatgggcggcggcggttttggcggcggcgcagacttcagcgatatttttggtgacgttttcggcgatatttttggcggcggacgtggtcgtcaacgtgcggcgcgcggtgctgatttacgctataacatggagctcaccctcgaagaagctgtacgtggcgtgaccaaagagatccgcattccgactctggaagagtgtgacgtttgccacggtagcggtgcaaaaccaggtacacagccgcagacctgtccgacctgtcatggttctggtcaggtgcagatgcgtcagggattcttcgctgtacagcagacctgtccacactgtcagggccgcggtacgctgatcaaagatccgtgcaacaaatgtcatggtcatggtcgtgttgagcgcagcaaaacgctgtccgttaaaatcccggcaggggtggacactggagaccgcatccgtcttgcgggcgaaggtgaagcgggcgagcatggcgcaccggcaggcgatctgtacgttcaggttcaggttaaacagcacccgattttcgagcgtgaaggcaacaacctctattgcgaagtcccgatcaacttcgctatggcggcgctgggtggcgaaatcgaagtaccgacccttgatggtcgcgtcaaactgaaagtgcctggcgaaacccagaccggtaagcttttccgtatgcgcggtaaaggcgtcaagtctgtccgcggtggcgcacagggtgatttgctgtgccgcgttgtcgtcgaaacaccggtaggcctgaacgagaagcagaaacagctgctgcaagagctgcaagaaagcttcggtggcccaaccggtgagcacaacagcccgcgctcaaagagcttctttgatggtgtgaagaagttttttgacgacctgacccgctaacctccccaaaagcctgcccgtgggcaggcttgggtaaaattagggtgcgttgaagatatgcgagcacctgaaaagtggcggggatcactcccataagcgctaacttaagggttgaaccatctgaagaatgcgacgcctcggtgcctcgttaagacgatgcctcgcgttcttcaattgcgttttgtaggctgtcagggatactgtcccacgaatggccacctgtaagctccagatgaccatttttgttattctccacaacgagttagttcttcttttcggatccggcacttctgggggggaaatccagcgatggctggattatgtcgtcaattaaaaatgcggcgagtagattagcaaatatccacgctttcgcgagttcaggttcctttgcacgcaaagcatccaggtgcagcaaacttttgagccgcttaaaagccagttcaatttgccatcgcagacggtaacaatcagccacttgctctgctgaatattcatcttccggtaatgatgttagcaatagcacatggcccgctgcttccagcgtttccgcctgaactactcgtccttttcgacgattctcgctgagcagtcgggttttactgattaatgctttttcgggaggaagtgatacggcaatgagacgtgccggaaagggagctccggcttttttattacctgaattgcctatcattacagtggtttcaccgttcttaccgcaatccagcccgcgcagaaaacccatcatgtcaaagcgcattccttctgcagttaaccagcgcaatcctcgccagtgaacccggacgatataatcagcttctccaaaagcaagtgagcggatacattcgggacgcgaaccgaatccccggtcagcaatgcgtatctcgtctgccgtttgcgcaaatcggtccagccgttcagcgtctctgctgtcggttagctcaaaatcagtgaactgacaggtatgaggatcatatcccatatgtagtcgccattcagcgctgccgcccccgggcgcactgattgctgttccatcgacaagacgcaatctctttccgcttgtacaacccgtaactgcggcgcgtacagcaagtgtttgtgcggcaagtatgccaaaccagtcggcggcattccgcagccgcttcaggagagccacgtcagataatgttgcaacgtcatggagctgagcccatgcagtgacttcacgtaatgacatccccccggggccgtaagccagccccagacgtagcagagttgcagcatcacgaatttcgcggcggcgggttagagccccggcattacgtgccgaagtatccagttcttcgggcttaccaatatgggccagaattgctgaccagttatcgtgagagtaattcatcggcacgttaaatcatatcaggcgtaataccacaacccttaagttagcgcttatgggatcactccccgccgttgcacttactcggattcgtaagccgtgaaaacagcaacctccgtctggccagttcggatgtgaacctcacagaggtcttttctcgttaccagcgccgccactacggcggtgatacagatgacgatcagggcgacaatcatcgccttatgctgcttcattgctctcttctccttgaccttacggtcagtaagaggcactctacatgtgttcagcatatagggggcctcgggttgatagtaaaatatcactcggggcttttctctatctgccgttcagctaatgcctgagacagatagcctcaagcacccgccgctattatatcgctctctttaacccattctgttttatcgattctaatcctgaagacgcctcgcatttttgtggcgtaattttttaatgatttaattatttaactttaatttatctctttatcgcaattattgacgacaagctggattatttttgaaatattgtcctaacaaataacgccgactgacaagaaattaattattacttttcctaattaatccctcagaaatcctcaccttaagctatgattatctgggcttagggtcactcgtgagcgcttacagccgtcaaaaactcatctcaccgctgatggcgcaaattcttcaatggatcgtaaaaaacgagttattcctacactataatctgattttaacgatgatttgtgcggggtagaatagtaaaaacgatctattcacctgaaagagaaataaaaagtgaaacatctgcatcgattctttagcagtgatgcctcgggaggcattattcttatcattgccgctatcctggcgatgattatggccaatagcggcgcaaccagtggatggtatcacgactttctggagacgccggttcagctccgggttggttcactcgaaatcaacaaaaacatgctgttatggataaatgacgcgctgatggcggtatttttcctgttagtcggtctggaagttaaacgtgaactgatgcaaggatcgctagccagcttacgccaggccgcatttccagttatcgccgctattggtgggatgattgttccggcattactctatctggcctttaactatgccgatccgattacccgcgaagggtgggcgatcccggcggctactgacattgcctttgcacttggtgtgctggcgctgttgggaagtcgtgttccgttagcgctgaagatctttttgatggctctggctattatcgacgatcttggggccatcattatcatcgcattgttctacactaatgacttatcgatggcctctcttggcgtcgcggctgtagcaattgcggtactcgcggtattgaatctgtgtggtgtacgccgcacgggcgtctatattctggttggcgtagtgttgtggactgcggtgttgaaatcgggggttcacgcaaccctggcgggggtaattgtcggcttctttattcctttgaaagagaagcatgggcgttctccagcgaagcgactggagcatgtgttacacccgtgggtggcgtatctgattttgccgctgtttgcatttgctaatgctggcgtttcactgcaaggtgtcacgctggatggcttgacctccattctgccattggggatcatcgctggcttgctgattggcaaaccgctggggattagtctgttctgctggttggcgctgcgtttgaaactggcgcatctgcctgagggaacgacttatcagcaaattatggcggtggggatcctgtgcggtatcggttttactatgtctatctttattgccagcctggcctttggtagcgtagatccagaactgattaactgggcgaaactcggtatcctggtcggttctatctcttcggcggtaattggatacagctggttacgcgttcgtttgcgtccatcagtttgacaggacggtttaccggggagccataaacggctcccttttcattgttatcagggagagaaatgagcatgtctcatatcaattacaaccacttgtattacttctggcatgtctataaagaaggttccgtggttggcgcagcggaggcgctttatttaactccacaaaccattaccggacagattcgagcgctggaagagcgcctgcaaggcaaattatttaaacgcaagggacgtggtctcgaacccagcgagctgggagaactggtctatcgctatgccgataaaatgttcaccttaagccaggaaatgctggatattgtgaactatcgcaaagaatccaatttattgtttgacgttggtgtggctgatgcactttccaaacgcctggtcagtagcgtacttaacgccgcagtggtagaaggcgagcccattcatcttcgctgcttcgaatccacccacgaaatgctgctggagcaattaagtcagcataaactggatatgatcatttctgactgtccgatagactctacgcagcaggaaggcctgttctccgtgagaattggcgaatgtggcgtgagtttctggtgtacaaatccaccaccagaaaaaccgttcccggcttgtctggaagaacggcgacttttgattcctgggcgacgttcaatgttagggcgcaaattgcttaactggtttaactcccagggattaaacgtagaaatcctcggcgagtttgatgatgccgcgttgatgaaagcttttggtgcgatgcacaatgcaatcttcgttgccccaacgctttatgcatatgacttttatgccgataaaactgtcgtagaaattggtcgcgtcgagaatgtgatggaagagtaccatgctatttttgctgagcggatgattcagcacccggcggtacagcgaatctgcaatacggattattctgcgctttttagtccagcggcgcgttaatcggcacctccccccaaagttaaggtgggggagatagattagttgtacataaccacgattttgactcggctcattatttgcccgcttgagacattatttccatatgtacgcgggcgaataaatagaggaatctgattacttccttcatggggatgctgaaaagagtagtaattgcttttaccatactggatttcattcgtaccatcattggagagttgaaagcctacttgacccgcaccgtcctcactgttttctaactcattttttaatatgctggttcctgactcctgtatcgtcactggttcaaagtaatattcaacatcactgggttcaaaaactaattcaccttgctcgccctggatgcagtcaaatcttatatgatgaaactgataattttcattattgatacgagacagtacaaatcgtccagtgtcgatggattgatcttcaaaaccacaggtcattaaatttacctgtaaaatagtatttaaattataattaaagcggacgctattacaattagtattattccctgtacatgaactcacttcaatttcgaacaacaaaggaaaaggagttccaggaaaaatgtctgcggtgttagaactatctgatacagatgcgatagaatatggaatggtgaaatttatcgcagatagcatttcttctaaattataagatgacttccctggaagctctatttttttaccgtcagattcaaaggggaaattaataatataatgacgacttccgactttaaaccttaaagcgttctgtgttaaaaaatgaactttaatggcgttggttgtctcttgcaagtctgtacactcaatgatatttccggtgttttcaatttttcggcggttagattacctttcatactcagtggcttgagtatatatgttccacgttgttcaccgacattggtcaatgcacagggagcactttgcacaataaaagaatatagactcaaggtgattaataaaagccacttcatagtaaactccttttactggcatatatatgttttgttttcatcgataacgtgttgaaaagtaatagtacagaataagttctgttcatcattgagagcaacttttattccagtgggaatttcatctacgcgaataaaaaggcgactaccctggccaacgactccaatattattttcctggagatccagtacgtcatagccaaaggttaatggcgaaccatcgggacgcagtgcctgtatataccagggcttacgttggtcagttgtaaactgcacataagaaactgctccacggtaaggtgcaataatttgacgattgccctgcaattctgtttcactttcactgtttgcaatatcaagtaccagatggttttcacgatgaggtattatcaggtcgtaaacaacctggcctttgctgtttgttcgattgtatttttgtccattaatatgtgcaccttctaacccaggcgcatccagaattgcaaatgtatcggataactggttagtgatattaataccaccgggccagacaactaatccactactaatacttccaccactttgctaggcgtttttagaatgactatagctgccatctattatggcgatgggagttctccagcttaaattcgtaccaagcgaggtatcattattttgttgttgctgattaacatatataccataatttaactgatcatgttcaccggctatgccagtaattccagtattgttggaggaatagccatctttggaaaatgaggtcgaattcgataagttaatttggtgacgtgttttggcaatatcatccccccagtagaaaggaatggagataaacagattaaaacgctcctcttctttattattttcatcataagattggctggcagagaaagtataactaatgtgttgccagttattggagtaactgaattggtaatctttagcatttccacttcgcccccagtaattccgccaaagcgcacttaatgatacatttcccagattattggataaaggttgcataatattagcagaaaggctattttttctgccaatatcataaaaatcatcataatcactctgatgatagtgtttatcattttcgtaaagatggtcgctgaatgtcctgtaatcctgcgaagcataacgccaggcggccacgctaaatcgagtggctgtttgtactagatatttattataggcgacctgatagctcgtaccttcgtgtctggtatcattatttaacttactactcgatcgggcagcgtaaaaagagatggcacccagcggtgtattccaaccatttcccagagttatagcattatagttatcggataaaatcgtacccgattatgtgatcaggttgttattatttagattaatgtttaaaatttttaatttcttgatgtgaagttgatgaaagtttaatattcttaattattcccttctttataagaagagcaaggtgccattattagagtgagagagtaggatgtttcagagtatgcttcagattattttttattcctctgtagtgaattaataatcatcacagttaatttcattctgaaattacttcttttttgagattttttaattttgatgagctatgtttttcataaggaacatacactcgttgatgcttttaaggtattttctcatttctgatgatgttttgtcgtaatcgtgcataaacttattaagttctttatacacatcattatttagctttacattgtcgcgaactaaagtttgtaccaatggtatcaaaatttcgaaacgggacggtttgtcatcaatacttgccagggttttgaatactcctgtgtatctgtaacctaagtgcttattgacaagttgagtggtccatcgaccaggcataatatcttcacagagcaaattttttattctggtattagtgaatgatgctccaaatatgttgctttttttaatgaagagattattaatttctccatttgaaaagatggtgtttgataagtcgctttcaaaacataatatattggataatacacaaccaaaataatacccatatgaaaggtcgctcttttctattgttatatttgatagcaacattttatgtatattaatattaagggcagtcaaatactggatgttttgctcgttaagttcatgcatctccagagatttattatagggtaataaaagtataaattcctttacattatttccgcagtaagaaaagacaacatcaaatttattggtgattgtgttttcagttgagcagtaagctgattttttattaatcgactgggtatgcttttaaataaagataattttttacatagttgtgaatatgcaatattgctagttttaaagttctgccacattattccctggttatcatctatcgatgaggaggggattttattgcattgctcattgtatagctcagggaaaatattttttttaataagctttttgatttcctggttaagatgactttttttcttgtctattgcactgtattttgcgttttgtgacgtttcctgatgatcataaaatgactggagatttctgcaggcctcataaaatatttcaggagtatatagctgtgggtatatttcttggttgaagtttgcctttaaaaaattaacgaatttttcatggcattcttggtatatcttaatctcttcagaaagacattcgcttgttctgtcatcaaaaacatccaatctaagtaatgtgatacctttgtgtttaaaaaaataaaattgaactgtatgttctatgagtttacatctataaaaatatgcatctctcagatgagtatattgaaaaaaatgatgaaggactggagatggtttaggcaagttatggcttctaaaaaagtcatcaaacaaaattaagaactctattttatactcgcaaaatacttttactaactcattttgtcttgttttatttattattacatcatctactatatttgatttataaagacaatgtggcgaagttgagataccatttgtcattatcagtccttgaagttgatgaatttttattaatttaatttatgcgtgaatgtgactactatcaaaaatagctcattaattttatgaagtagaatataaataggtatttaacctgtgttgattgttgttaattatttacaagatctaataaggagatatttatgaatggttaaagtgtataggaatttaactcaaaaatagagtggtcttaagtttaatacctcaatgtgtatcacaatatccacattctttgtaggggagtctggagattgagtagatattcttgttcagaatgtatcagccgatggttctacgattcttaagccacgaagagttcagaaagtgtaacggcatgtctgcaaaagccagcatcttttgactatctggcaaccggtagtgtgttctctcacgcatcataaaagcagcaggcataaaaaaacccgcttgcgcgggctttttcacaaagcttcagcaaattggcgattaagccagtttgttgatctgtgcagtcaggttagccttatgacgtgcagctttgtttttgtggatcagacctttagcagcctgacggtccacgatcggttgcatttcgttaaatgctttctgtgcagcagctttgtcgccagcttcgatagctgcgtatactttcttgatgaaagtacgcatcatagagcgacggcttgcgttgtgcttacgagccttttcagactgaatggcgcgcttcttagctgatttgatattagccaaggtccaactcccaaatgtgttctatatggacaattcaaaggccgaggaatatgcccttttagccttcttttgtcaatggatttgtgcaaataagcgccgttaatgtgccggcactcgttacgtagtgatggcgcaggattctaccagcttgcggggtgtgaatacagcttttccgcgataaaaattgcagcaggcggtcactttcttcccgtgatttgcgccatggcaatgaaaagccacttctttctgatttcggtactcaatcgccggttaaccttgaccgctgtacaaggtatactcggacgattttcactgttttgagccagacatgaagctgatacgcggcatacataatctcagccaggccccgcaagaagggtgtgtgctgactattggtaatttcgacggcgtgcatcgcggtcatcgcgcgctgttacagggcttgcaggaagaagggcgcaagcgcaacttaccggtgatggtgatgctttttgaacctcaaccactggaactgtttgctaccgataaagccccggcacggctgacccggctgcgggaaaaactgcgttaccttgcagagtgtggcgttgattacgtgctgtgcgtgcgtttcgacaggcgtttcgcggcgttaaccgcgcaaaatttcatcagcgatcttctggtgaagcatttgcgcgtaaaatttcttgccgtaggtgatgatttccgctttggcgctggtcgtgaaggcgatttcttgttattacagaaagctggcatggaatacggcttcgatatcaccagtacgcaaactttttgcgaaggtggcgtgcgtatcagcagcaccgctgtgcgtcaggcgctggcggatgacaatctggctctggcagaaagtttactggggcacccgtttgccatctccgggcgtgtagtccacggtgatgaattagggcgcactataggtttcccgacggcgaatgtaccgctacgccgtcaggtttccccggtgaaaggggtttatgcggtagaagtgctgggcctcggtgaaaagccgttacccggcgtggcaaacattggaacacgcccaacggttgccggtattcgccagcagctggaagtgcatttgttagatgttgcaatggacctttacggtcgccatatacaagtagtgctgcgtaaaaaaatacgcaatgagcagcgatttgcgtcgctggacgaactgaaagcgcagattgcgcgtgatgaattaaccgcccgcgaattttttgggctaacaaaaccggcttaagcctgttatgtaatcaaaccgaaacacggaaccgagaatctgatgagtgactataaatcaaccctgaatttgccggaaacagggttcccgatgcgtggcgatctcgccaagcgcgaaccgggaatgctggcgcgttggactgatgatgatctgtacggcatcatccgtgcggctaaaaaaggcaaaaaaaccttcattctgcatgatggccctccttatgcgaatggcagcattcatattggtcactcggttaacaagattctgaaagacattatcgtgaagtccaaagggctttccggttatgactcgccgtatgtgcctggctgggactgccacggtctgccgatcgagctgaaagtagagcaagaatacggtaagccgggtgagaaattcaccgccgccgagttccgcgccaagtgccgcgaatacgcggcgacccaggttgacggtcaacgcaaagactttatccgtctgggcgtgctgggcgactggtcgcacccgtacctgaccatggacttcaaaactgaagccaacatcatccgcgcgctgggcaaaatcatcggcaacggtcacctgcacaaaggcgcgaagccagttcactggtgcgttgactgccgttctgcgctggcggaagcggaagttgagtattacgacaaaacttctctgtccatcgacgttgcttttcaggcggtcgatcaggatgcactgaaagcaaaatttgccgtaagcaacgttaacggcccaatctcgctggtgatctggaccactacgccgtggactctgcctgcgaaccgcgcaatctctattgcacctgatttcgactatgcgctggtgcagatcgacggtcaggccgtgattctggcgaaagatctggttgaaagcgtaatgcagcgtatcggcgtgaccgattacaccattctcggcacggtaaaaggtgcggagcttgagttgctgcgctttacccatccgtttatgggcttcgacgttccggcaatcctcggcgatcacgttaccctggatgccggtaccggtgccgttcacaccgcgcctggccacggcccggacgactatgtgatcggtcagaaatacggcctggaaaccgctaacccggttggcccggacggcacttatctgccgggcacttatccgacgctggatggcgtgaacgtcttcaaagcgaacgacatcgtcgttgcgctgctgcaggaaaaaggcgcgctgctgcacgttgagaaaatgcagcacagctatccgtgctgctggcgtcacaaaacgccgatcatcttccgcgcgacgccgcagtggttcgtcagcatggatcagaaaggtctgcgtgcgcagtcactgaaagagatcaaaggcgtgcagtggatcccggactggggccaggcgcgtatcgagtcgatggttgctaaccgtcctgactggtgtatctcccgtcagcgcacctggggcgtaccgatgtcactgttcgtgcacaaagacacggaagagctgcatccgcgtactctcgaactaatggaagaagtggcaaaacgcgttgaagttgacggcatccaggcgtggtgggatcttgatgcgaaagagatcctcggcgatgaagctgatcagtacgtgaaagtgccggacacattggatgtatggtttgactccggatctacccactcttctgttgttgacgtgcgtccggaatttgccggtcacgcagcggacatgtatctggaaggttctgaccagcaccgtggttggttcatgtcttccctaatgatctccaccgcgatgaaaggcaaagcgccgtatcgtcaggtactgacccacggctttaccgtggatggtcagggtcgcaagatgtctaaatccatcggcaataccgtttcgccgcaggatgtgatgaacaaactgggcgcggatattctgcgtctgtgggtggcatcaaccgactacaccggtgaaatggccgtttctgacgagatcctgaaacgtgctgccgatagctatcgtcgtatccgtaacaccgcgcgcttcctgctggcaaacctgaacggttttgatccagcaaaagatatggtgaaaccggaagagatggtggtactggatcgctgggccgtaggttgtgcgaaagcggcacaggaagacatcctcaaggcgtacgaagcatacgatttccacgaagtggtacagcgtctgatgcgcttctgctccgttgagatgggttccttctacctcgacatcatcaaagaccgtcagtacaccgccaaagcggacagtgtggcgcgtcgtagctgccagactgcgctgtatcacatcgcagaagcgctggtgcgctggatggcaccaatcctctccttcaccgctgatgaagtgtggggctacctgccgggcgaacgtgaaaaatacgtcttcaccggtgagtggtacgaaggcctgtttggcctggcagacagtgaagcgatgaacgatgcgttctgggacgagctgttgaaagtgcgtggcgaagtgaacaaagtcattgagcaagcgcgtgccgacaagaaagtgggtggctcgctggaagcggcagtaaccttgtatgcagaaccggaactgtcggcgaaactgaccgcgctgggcgatgaattacgatttgtcctgttgacctccggcgctaccgttgcagactataacgacgcacctgctgatgctcagcagagcgaagtactcaaagggctgaaagtcgcgttgagtaaagccgaaggtgagaagtgcccacgctgctggcactacacccaggatgtcggcaaggtggcggaacacgcagaaatctgcggccgctgtgtcagcaacgtcgccggtgacggtgaaaaacgtaagtttgcctgatgagtcaatcgatctgttcaacagggctacgctggctgtggctggtggtagtcgtgctgattatcgatctgggcagcaaatacctgatcctccagaactttgctctgggggatacggtcccgctgttcccgtcgcttaatctgcattatgcgcgtaactatggcgcggcgtttagtttccttgccgatagcggcggctggcagcgttggttctttgccggtattgcgattggtattagcgtgatcctggcagtgatgatgtatcgctcgaaggccacgcagaagctaaacaatatcgcttatgcgctgattattggcggcgcgctgggcaacctgttcgaccgcctgtggcacggcttcgttgtcgatatgatcgacttctacgtcggcgactggcacttcgccaccttcaaccttgccgatactgccatttgtgtcggtgcggcactgattgtgctggaaggttttttgccttctaaagcgaaaaaacaataataaaccctgccggataaggcctacagattgctgcgaaatcgtaggccgcatccggcaaaaatcctcaaaatataagagcaaacctgcatgtctgaatctgtacagagcaatagcgccgtcctggtgcacttcacgctaaaactcgacgatggcaccaccgccgagtctacccgcaacaacggtaaaccggcgctgttccgcctgggtgatgcttctctttctgaagggctggagcaacacctgttggggctgaaagtgggcgataaaaccaccttctcgttggagccagatgcggcgtttggcgtgccgtcaccggacctgattcagtacttctcccgccgtgaatttatggatgcaggcgagccagaaattggcgcaatcatgctttttaccgcaatggatggcagtgagatgcctggcgtgatccgcgaaattaacggcgactccattaccgttgatttcaaccatccgctggccgggcagaccgttcattttgatattgaagtgctggaaatcgatccggcactggaggcgtaacatgcagatcctgttggccaacccgcgtggtttttgtgccggggtagaccgcgctatcagcattgttgaaaacgcgctggccatttacggcgcaccgatatatgtccgtcacgaagtggtacataaccgctatgtggtcgatagcttgcgtgagcgtggggctatctttattgagcagattagcgaagtaccggacggcgcgatcctgattttctccgcacacggtgtttctcaggcggtacgtaacgaagcaaaaagtcgcgatttgacggtatttgacgcgacctgtccgctggtgaccaaagtgcatatggaagtcgcccgcgctagtcgccgtggcgaagaatctattctcatcggtcacgccgggcacccggaagtggaaggcacgatgggtcagtacagcaacccggaagggggaatgtatctggttgaatcaccagacgatgtgtggaaactgacggtcaaaaacgaagagaaactctcctttatgacccagaccacgctgtcggtggatgacacgtctgatgtgatcgacgcgctgcgtaaacgcttcccgaaaattgtcggtccgcgcaaagatgacatctgctacgccacgactaaccgacaggaagcggtacgtgccctggccgaacaggcggaagttgtgctggtggtcggttcgaaaaactcctctaactccaaccgtctggcggagctggcccagcgtatgggcaaaagcgcgtttttgattgatgatgcgaaagatatccaggaagagtgggtgaaagaggttaaatgcgtcggcgtgactgcgggcgcatcggctccggatattctggtgcagaatgtggtggcacgtttgcaacagctgggcggtggtgaagccattccgctggaaggacgtgaagaaaacattgttttcgaagtgccgaaagagctgcgtgtcgatattcgtgaagtcgattaagtcattagcagcctaagttatgcgaaaatgccggtcttgttaccggcattttttatggagaaaacatgcgtttacctatcttcctcgatactgaccccggcattgacgatgccgtcgccattgccgccgcgatttttgcacccgaactcgacctgcaactgatgaccaccgtcgcgggtaatgtctcggttgagaaaactacccgcaatgccctgcaactgctgcatttctggaatgcggagattccgctcgcccaaggggccgctgtgccgctggtacgcgcaccgcgtgatgcggcatctgtgcacggcgaatcgggaatggctggctacgactttgttgagcacaaccgaaagccgctcgggataccggcgtttctggcgattcgggatgccctgatgcgtgcaccagagcctgttaccctggtggccattggcccgttaaccaatattgcgctgttactttcacaatgcccggaatgcaagccgtatattcgccgtctggtgatcatgggtggttctgccggacgcggcaactgtacgccaaacgccgagtttaatatcgctgccgatccagaagcggctgcctgtgtcttccgtagcggaatcgaaatcgtcatgtgcggtctggatgtcaccaatcaggcaatattaacccctgactatctcgctactttgccggagttgaatcgcaccggaaaaatgcttcatgcactgtttagccactaccgtagcggcagtatgcaaagcggtctgcgaatgcacgatctctgcgccatcgcctggctggtgcgcccggacttattcaccctcaagccgtgttttgtcgcggtagaaactcaaggcgaatttacctcaggcacgacggtggttgatatcgacggttgcctgggcaaaccagccaatgtaaaggtggcattggatctggatgtgaaaggcttccagcagtgggtggctgaggtgctggctctggcgtcgtaacctgtcacatgttatcggcatgcagtcattcatcgactcatgcctttcactgatatccctccctgtttatcattaatttctaattatcagcgtttttggctggcggcgtagcgatgcgctggttactctgaaaacggtctatgcaaattaacaaaagagaatagctatgcatgatgcaaacatccgcgttgccatcgcgggagccggggggcgtatgggccgccagttgattcaggcggcgctggcattagaaggcgtgcagctgggcgcggcgctggagcgcgaaggatcttctttactgggcagcgacgccggtgagctggctggtgcagggaaaacaggcgttaccgtgcaaagcagcctcgatgcggtaaaagatgattttgatgtgtttatcgattttacccgtccggaaggtacgctgaaccatctcgctttttgtcgccagcatggcaaagggatggtgatcggcactacggggtttgacgaagccggtaaacaggcgattcgtgacgccgccgccgatattgcgattgtctttgccgccaattttagcgttggcgttaacgtcatgcttaagctgctggagaaagcagccaaagtgatgggtgactacaccgatatcgaaattattgaagcacatcatagacataaagttgatgcgccgtcaggcaccgcactggcaatgggagaggcgatcgcccacgcccttgataaagatctgaaagattgcgcggtctacagtcgtgaaggccacaccggtgaacgtgtgcctggcaccattggttttgccaccgtgcgtgcaggtgacatcgttggcgaacataccgcgatgtttgccgatattggcgagcgtctggagatcacccataaggcgtccagccgcatgacatttgctaacggcgcggtaagatcggctttgtggttgagtggtaaggaaagtggtctttttgatatgcgagatgtgcttgatctcaatagtttgtaaccacaaaatatttgttatggtgcaagaataacacatttaatttattgattataaagggctttaatttttggcccttttatttttagtgttatgtttttaaattgtctataagtgccaaaaattacatgttttgtcttctgtttttgttgttttaatgtaaattttgaccatttggtccacttttccctgctcgcttttatttcatgcaatcttcttgctgcgcaagcgttttccagaacaggttatatgatctttttgtcgcttaatgcctgtaaaacatgcatgagccacaaaataatataaaaaatcccgccattaagttgacttttagcgcccatatctccagaatgccgccgtttgccagaaattcgtcggtaagcagatttgcattgatttacgtcatcattgtgaattaatatgcaaataaagtgagtgaatattctctggagggtgttttgattaagtcagcgctattggttctggaagacggaacccagtttcacggtcgggccataggggcaacaggttcggcggttggggaagtcgttttcaatacttcaatgaccggttatcaagaaatcctcactgatccttcctattctcgtcaaatcgttactcttacttatccccatattggcaatgtcggcactaatgacgccgatgaagaatcttctcaggtacatgcacaaggtctggtgattcgcgatctgccgctgattgccagcaacttccgtaataccgaagacctttcttcttacctgaagcgccataacatcgtggcgattgccgatatcgatacccgtaagctgacgcgtttactgcgcgagaaaggcgcacagaatggctgcattatcgcaggcgataacccggatgcggcgttggcgttagaaaaagcccgcgcgttcccaggtctgaatggcatggatctggcaaaagaagtgaccaccgcagaagcctatagctggacacaagggagctggacgttgaccggcggcctgccagaagcgaaaaaagaagacgagctgccgttccacgtcgtggcttatgattttggtgccaagcgcaacatcctgcggatgctggtggatagaggctgtcgcctgaccatcgttccggcgcaaacttctgcggaagatgtgctgaaaatgaatccagacggcatcttcctctccaacggtcctggcgacccggccccgtgcgattacgccattaccgccatccagaaattcctcgaaaccgatattccggtattcggcatctgcctcggtcatcagctgctggcgctggcgagcggtgcgaagactgtcaaaatgaaatttggtcaccacggcggcaaccatccggttaaagatgtggagaaaaacgtggtgatgatcaccgcccagaaccacggttttgcggtggatgaagcaacattacctgcaaacctgcgtgtcacgcataaatccctgttcgacggtacgttacagggcattcatcgcactgataaaccggcgttcagcttccagggtcacccggaagccagccctgggccacacgacgcagcgccgttgttcgaccactttatcgagttaattgagcagtaccgtaaaaccgctaagtaatcaggagtaaaagagccatgccaaaacgtacagatataaaaagtatcctgattctgggtgcgggcccgattgttatcggtcaggcgtgtgagtttgactactctggcgcgcaagcatgtaaagccctgcgcgaagagggttaccgcgtcattctggtgaactccaacccggcgaccatcatgaccgacccggaaatggccgatgcgacctacatcgagccgattcactgggaagtagtacgcaagattattgaaaaagagcgcccggacgcggtgctgccaacgatgggcggtcagacggcgctgaactgcgcgctggagctggagcgtcagggcgtgttggaagagttcggcgtgactatgattggtgcgaccgccgatgcgattgataaagcagaagaccgccgtcgtttcgacgtagcgatgaagaaaattggtctggaaaccgcgcgttccggtatcgcacacacgatggaagaagcgctggcggttgccgctgacgtgggcttcccgtgcattattcgcccatcctttaccatgggcggtagcggcggcggtatcgcttataaccgcgaagagtttgaagaaatttgcgcccgcggtctggatctctccccaaccaaagagctgctgattgatgagtcgctgatcggctggaaagagtacgagatggaagtggtgcgtgataaaaacgacaactgcatcatcgtctgctctatcgaaaactttgatgcgatgggcatccataccggtgactccatcactgtcgcgccagcccaaacgctgaccgacaaagaatatcaaatcatgcgtaacgcctcgatggcggtgctgcgtgaaatcggcgttgaaaccggtggttccaatgtccagtttgcggtgaacccgaaaaacggtcgcctgattgttatcgaaatgaacccacgcgtgtcccgttcttcggcgctggcgtcgaaagcgaccggtttcccgattgctaaagtggcggcgaaactggcggtgggttacaccctcgacgaactgatgaacgacatcactggcggacgtactccggcctccttcgagccgtccatcgactatgtggttactaaaattcctcgcttcaacttcgaaaaattcgctggtgctaacgaccgtctgaccactcagatgaaatcggttggcgaagtgatggcgattggtcgcacgcagcaggaatccctgcaaaaagcgctgcgcggcctggaagtcggtgcgactggattcgacccgaaagtgagcctcgatgacccggaagcgttaaccaaaatccgtcgcgaactgaaagatgctggcgcagagcgtatctggtacatcgccgatgccttccgtgcgggcctgtctgtggacggcgtgttcaacctgaccaatattgaccgctggttcctggtacagattgaagaactggtgcgtctggaagagaaagtagcggaagtgggcatcactggcctgaacgctgaattcctgcgccagctgaaacgcaaaggctttgccgatgcgcgtctggcaaaactggcgggcgtgcgcgaagcggaaatccgcaagctgcgcgaccagtatgacctgcacccggtttataagcgcgtggatacctgtgcggcagagttcgccaccgacaccgcttacatgtactccacttatgaagaagagtgcgaagcgaatccgtctaccgaccgtgaaaaaatcatggttctcggcggcggcccgaaccgtatcggtcagggtatcgaattcgactactgctgtgtacacgcctcgctggcgctgcgcgaagacggttacgaaaccattatggttaactgtaacccggaaaccgtctccaccgactacgacacttccgatcgcctctacttcgagccggtaactctggaagatgtgctagaaatcgtgcgtattgagaagccgaaaggcgttatcgttcagtacggcggtcagaccccgctgaaactggcgcgcgcgctggaagctgctggcgtaccggttatcggcaccagcccggatgctatcgaccgtgcagaagaccgtgaacgcttccagcatgcggttgagcgtctgaaactgaaacaaccggcgaacgccaccgttaccgctattgaaatggcggtagagaaggcgaaagagattggctacccgctggtggtacgtccgtcttacgttctcggcggtcgggcgatggaaatcgtctatgacgaagctgacctgcgtcgctacttccagacggcggtcagcgtgtctaacgatgcgccagtgttgctggatcacttccttgatgacgcggtagaagttgacgtggatgccatctgcgacggcgaaatggtgctgattggcggcatcatggagcacatcgagcaggcgggcgtgcactccggtgactccgcatgttctctgccagcctacaccttaagtcaggaaattcaggatgtgatgcgccagcaggtgcagaaactggccttcgaattgcaggtgcgcggtctgatgaacgtgcagtttgcggtgaaaaacaacgaagtctacctgattgaagttaacccgcgtgcggcgcgtaccgttccgttcgtctccaaagccaccggcgtaccgctggcaaaagtggcggcgcgtgtgatggctggcaaatcgctggctgagcagggcgtaaccaaagaagttatcccgccgtactactcggtgaaagaagtggtgctgccgttcaataaattcccgggtgttgacccgctgttagggccagaaatgcgctccaccggggaagtgatgggcgtgggccgcaccttcgctgaagcgtttgccaaagcgcagctgggcagcaactccaccatgaagaaacacggtcgtgcgctgctttccgtgcgcgaaggcgataaagaacgcgtggtggacctggcggcaaaactgctgaaacagggcttcgagctggatgcgacccacggcacggcgattgtgctgggcgaagcgggcattaatccgcgtctggtgaacaaggtgcatgaaggccgtccgcacattcaggaccgcatcaagaatggcgaatatacctacatcatcaacaccacttcaggccgtcgcgcgattgaagactcccgcgtgatccgtcgcagtgcgctgcaatataaagtgcattatgacaccaccctgaacggtggtttcgctaccgcgatggcgctgaatgccgacgcgaccgaaaaagtaatttcggtgcaggaaatgcacgcgcagatcaaataatagcgtgtcatggcggatatttttcatccgctaatttgatcgaataagtaatacggttctctgatgaggaccgttttttttgcccattaagtaaatcttttggggaatcgatatttttgatgacataagcaggatttagctcacacttatcgacggtgaagttgcatactatcgatatatccacaattttaatatggccttgtttaattgcttcaaaacgagtcatagccagacttttaatttgtgaaactggagttcgtatgtgtgaaggatatgttgaaaaaccactctacttgttaatcgccgaatggatgatggctgaaaatcggtgggtgatagcaagagagatctctattcatttcgatattgaacacagcaaggcggttaataccctgacttatattctgtcggaagtcgcagaaataagctgcgaagttaagatgatccctaataagctggaaggacggggatgccagtgccagcgactggtaaaagtggtcgatatcgatgagcaaatttacgcgcgcctgcgcaataacagccgggataaattagtcggcgtaagaaagacgccgcgtattcctgccgttccgctcacggaacttaaccgcgagcagaagtggcagatgatgttgtcaaagagtatgcgtcgttaattttatctcgttgataccgggcgtcctgcttgccagatgcgatgttgtagcatcttatccagcaaccaggtcgcatccggcaagatcaccgtttaggcgtcacatccgtcgtcccctgcaaacgggggcgattttcctccatttgcctcagtggctgtgtttcatgtaacgatgcatgacagcgcccgacaagatcctgatactctttggtattcaaccgtttccagtgtaactcgtcgtcactaacactgcgtacagcgcgggctggcgtacccatcaacaactggcgtttctcgccgtgaaagcctgctttgacaaagctcatggcggcaacaatgctctcttcgccaatgaccgcgccatccataatcacgctgttcatcccgaccaatgcatcgcgaccaatcacacaaccatgcaggatcgctccgtgcccgatatggccgttttccccaacgatggtgtcagtgtcgcagtagccatgcataatgcagccatcctgaatattggctcccgcttgcacgatcaaccgcccgtagtcaccacgcagtgaggcgagtgggccgatgtagacaccggctcccacaatcacatcgccaatcaagacggcactgggatggacaaacgccgtcgggtgaaccaccggaattaacccctcaaaggcgtaatagctcacggttgttaacgtcctttccacaccggatcgcgcttctcggcaaacgccagcggcccttcaatggcatcctccgaatgcagaaccgacggatagtgtttcaacacgccgctgcgaatatagcgatacgcttcttctaccggcatttcgctggtggtgcggaagatctctttcagcgccgcaatcgccagcggggcgctgttaaccagctgctgcgccagttcgcgggcgttatccatcagttccgcctggctaaccacgcggttgactatcccccaacgcagcgcctcttctgcgcccattcgtctgccggtcatcaccatttcattgacgatggcaggcggcaggatcttcggtagacgcagcacgccgccgctgtcaggaacgatgcccagcttggcttccggcagggcgaagctggcgttatcggcacaaacaataaaatctgccgccagcgccagttcgaaaccgccgccaaaggcatagccgttcacagctgcgataaccggtttgtcgagattgaaaatttcggttaatcccgcaaatccacccgggccaaagtcagcatccggtgcttcgccttctgctgccgcttttaaatcccagcccgcggaaaagaacttctctccggcaccggtaataatggcgacacgtaattgcggatcgtcacggaaatttagaaatacttcgcccatttcaaagctggtttttgcatcaatagcattcgcttttggacgatcaagggtaatttccagaattgatccattgcgggtcagatgtaatgattcactcattccttttctccatttttgctttttcagggacgacaacatccctgcaaaaaatgcatattgttttatagcgtgattattagctggcagggtagttccctgctgtttcatttatttcagattctttctaattattttccccgagcaattacgtggcagatcttttctgatctccagataagagggcactttaaatttcgccatattttgttcgcagaagcggaaaaattcctcttcgctcaatgtttcaccttcattcagcaccacaaatgctttgatggcttcatcgcgaatcgaatctttaatacccacaaccacgatatcctgaatttttggatgggtggcgatgatattttccagctccacgcaggagacattctcgccaccgcgtttgatcatattgcagcggcgatcgacgaaataaaaaaagccctcttcgtcgcagtatccggtatcgccggtatgtagccagccgtcggcttccagcactttcgcagtggctttcgggttgagaaaatactctttgaagatggttttccctggtacgcctttaatacagatttcaccgatctcacctgccgggagcgggcgattgtgatcgtcgcggatctccgcttcgtagcaaaaccccgcccgaccaatcgacggccagcgtcgtttatcgccagggcgatcgccgataatgcccacaatggtttccgtcatcccataagacgtcagcaagcgaacgccgaagcgttcacaaaacgcatctttttcctgctccgacaagttgagataaaacatcacttcccgcaggcggtgttgccgatcgttcgctgaaggcggctgcaccatcaacgtacggatcatcatcggaatacattcggtaatggtggcgcggtacttctgcacctgtccccagaaggcgcgggcgctgtatttctcgaccagcacaaaggtggccccggcagaaaacgccgccatcgccgcagtacactggcaatcgatatgaaacgcaggcattaccgtcaggtagacgtcatcgtcacgcagtgcacactgccaggcggagtaatatccagcgaagcgcaggttgtaatgggtaatcaccacacctttcggtcgggaggtggtgccggaggtgaagagaatttccgccgtatcgtcagtcgatagcggcggtgcatagcacaaggtggcaggttgttgatttttcagttgagtaaacgaactcacgccatcatcagcgggaagtgccacatctgtcaggcaaatgtgccgcaattgagtggcatcttcctgctgaatctgttgatacataggatagaattgcgcactggtcaccagcaggcacgcctggctattttgcaggatccacgcgctttcctcgcgtaacaggcgggcgttaatcggcaccataatcgcgccaatttttgccagcccgaaccagcaaaagataaattccgggcagttgtcgagatgtagtgcaaccttgtcgcctttgcgaatccccagcgtataaaacaggtttgccgtgcggttaatctcctgatttaactcaagataactataccggttaacgactccgccgctggattcacaaatcagcgccgttttatgaccgtaaacgtccgcaagatcgtcccacatttgacgtagatgttgtccgccaatgatatccattgcacctctatccatttttgttcgtttgttattgggcgggcgctagtcaggcaagccgactgacgccacgcgtttagtcctcaactttggccagacctttgctgaccaactcctgaatgtcgttttcgctgtagccgatatttttcaaaatggcagccgtgtccatgccatgtgagggcattccgcgccagatttgtccggggttatttttgaatttcggcatgatgttcggccctttgcaggtgcgaccatccatcgtttgccactgagtgattgattcacgggcaacatactgtggattgctttccagttccggtacggtcagtactttggcacaggcgatattcagttcggcaaagcgttctttaacttctgcgatggtatgtgccgccagccaggcatcgagtttttcttctaccagtgggccgtaagggcattcgatacggtggataagctgagtgccttccgggatttccggcgtaccgagtagatgtgcgaggccaatatctttaaagcactcttcaatttgggtaatgcccaccagttccatcacgatgtagccgtcggcgcatttatacagaccgcaaccggcgtagtagggatctttacctttgctcatgcgcgggcacatttcgccgccgttgaagtaatccatcatgaagtactggcccatacgcagcatcacttcatacatggcgatgtcgatactttcgcctttaccggtttcacgcactttatgcagtgctgccagcgccgccgtggtggcggtcaggccagaaaagtaatcggcggtatacgggaaggcaggcattggctggtcaacatcaccgttctgaatcaggtaaccactaaaggcctgggcgatagtgttataggccggaagattggtgtactcctcggtgccgtactgaccaaaaccggacaggtgagcgataaccagtttcgggttgtgctgccacagtacttcatcggtaatgccacgacgggcaaaggccggacctttactggcttcgatgaagatatcggtggtttccattaatttcagaaacgcttcgcggccttcatctttgaaaatatttaacgacagcgcgtgcaaattgcggcgggagagttgcgggtagttcggttgaacgcgaatggtgtcggcccaggcgacgttctcgatccagataacttccgcgccccattctgcgaacatttgcccggcaaacggtccggcgatttcgataccggagaagacaacgcgcaatccggccaacggcccgaatttcggcatgggtagatgatccattatttgctcctgaaaaatttatgtagcgcatgactgccggatgcggcgtaaacgctttatccggcctacattcgtgctcccgtaggcctgataagacgcatcagcgtcgcatcaggcagcgcattgacttagcggtattgcttcagcaccgcacgacccagcgtcaggatctgcatttcgtcagatcccccggagacgcggtctacacgcaggtcacgccagaagcggctgatgcggtggttgcccgcaatcccgacaccgcccagcacctgcattgcgctatccaccacttcaaatgccgcattggcgcagaagtatttgcacatcgctgcatcgccagaggtgatggtgccgttgtctgctttccacgctgcttcatacagcatgtttttcatggagtttaatttgatcgccatgtgggcgaatttttcctgaatcaactggaaacgaccaatagcctcgccaaactgcacgcgctggttggcgtagcgcgccgcatcttcaaaggcgcacatcgccgtaccgtagttggtcagggctaccaggaaacgttcatggtcgaactcttctttgacgcggttaaagccgttaccttcccgaccgaacatgtctttctcgtccagttccacgtcgtcaaaggtgatttcacagcagctatccatacgcagaccgagcttttcaagtttggtcactttgatgcccggtttgctcatatcaacaaaccattcggtgtagacaggtttgtccggagaagccccgtcgcgcgccatcaccacgatgtacggggtgtaggcgctgctggtaataaaacacttactaccattaagataaatcttaccatttctacgggtataagtcgttttcaggctacccacgtcggagcccgcgcccggttcggtaatcgctgagttccacatctgcttaccggtgccgcggaaagccataatcttgtcgatctgctcttgtgtgccttcgcgcaggaaggtgttgaacccgcccggcaactggtacagtacataggttggtgcccccagacgtcccagctccatccacacggcggcgagagtaacaaaccccgcgtccagaccaccgtgctcttcagggatcagcagactgtcgatacccatatccgccagtgctttgacaaaacgttccgggtagacgctgtcacggtcgcactcggcaaaataggcctcccagttttcgctggccatcagttcgcggataccggcgacaaacagttcctgctcatcatttaaattaaaatccatctttcaacctcttgatattttgggggttaattaatctttccagttctgtttcgcgtctttaataaaggagagcgtcaccataatgttgacgaagaacagcgggcatcctccggcgataatggcagtttgaatcggtttcaggccgccgagcgccagcaaaacaataccgataatgccaaccagaattgaccaaccgatacgcaccagcagcggtggttcttcaccatcgcgtacttcgcggcaagtggacatcgccagggtataagagcaggcgttaaccagcgtaacggtggcaataaagcagaggatgaagaagccccacatggtggcggtgctgagtggcagagcggcccaggtttcgataatggcgcgcgccacaccgtactgttcgatcagatttggaatgttgataatgtttttatctatcaacagcagagtgttactaccgagtacagtccacaggatccaggttgacgctgtcagccccagcaccatgccgaagcacagttcacgcacagtacgaccacgggagatgcgggcgaggaagatactcatctggatagcataaatcacccaccatgcccagtagaacacggtccagccctgcgggaagccgcctttagcgatgggatcggtatagaacaacatgcgcggcagatacatcagcaacatccccaccgaatcggtgaagtagttcatgatgaagctggcaccgctgacaatgaacacccaacccagcatcaggaagctcaggtaactacgcacgtcactggcgatacgtacccctttttgcagaccgcaagcgacgcaaatggcgttgaggataatccagcaggtaatgatgatagcgtccagttgcagggtatgcggaatgccaaacaaccattgcatacactcggtcaccagcggcgtggcaaggcccagactggtacccatcgcgaagatcaaggcgacgagatagaagttgtcgacgatagtgccgaacaaccctttggcgtgtttttcacctaccagcggcaccagtgtcgagctggggcgaatcacttccattttgcggacaaagaagaagtaagcgaaggcgactgaaaggaagctgtaagtggcccacggcagaggtccccagtggaacaagctgtaagccagccccaactctttcgcccctgtcgagttcggttctaagccaaacggcggggtggagatgtagtagtagatctcaatcgatccccagaacagtacggcagcagacgtacaggaggcgaacatcataaagatccaactggcggtactaaattcaggtggttcgttacctaaacgctttttggcatacgggccaaacaccagccagaaccaaccgaaaagcatcaccaccatataccattcaaatgcccatccccatacattggtgacgtaactgaatacagcattaataacgacattcgctgcatccagatctctgactgtaagccaacaaagtatgccgacgattattaacggcggaaagaaaaccttcggttctattcccgtttttctcttttcattcttcatgagttaattccactgtgaaaacgaatatttattttgcgttcccgtttgttttatttttgttaacatttaatataattattattaacctcgtggacgcgttaatggctaactcataatgggtattcaataagctgcattctgtgattgttatcacatttttgtttcgggtgaatagagggcgcttttctcgttaattttgattattaatcagtttgttatgttgtgttgtgagtaaaaaaatagcatctgactttcaatattggtgatccataaagcaatattgaaaatttctttttgctacgccatgttttcaatattggtgaggaacttaacaatattgaaagttggatttatctgcgtgtgacattttcaatattggtgattaaagttttatttccaaattaaagggcgtgatatctgtaattaacaccaccgatatgaacgacgtttccttcatgatttctggagatgcaatgaagattattacttgctataagtgcgtgcctgatgaacaggatattgcggtcaataatgctgatggttcattagacttcagcaaagccgatgccaaaataagccaatacgatctgaacgctattgaagcggcttgccagctaaagcaacaggcagcagaggcgcaggtgacggccttaagtgtgggcggtaaagccctgaccaacgccaaagggcgtaaagatgtgctatcgcgcggcccggatgaactgattgtggtgattgatgaccagttcgagcaggcactgccgcaacaaacggcgagcgcactggctgcagccgcccagaaagcaggctttgatttgatcctctgtggcgatggttcttccgacctttatgcccagcaggttggtctgctggtgggcgaaatcctcaatattccggcagttaacggcgtcagcaaaattatctccctgactgcagataccctcaccgttgagcgcgaactggaagatgaaaccgaaaccttaagcattccgctgcctgcggttgttgctgtttccactgatatcaactccccacaaattccttcgatgaaagccattctcggcgcggcgaaaaagcccgtccaggtatggtcggcggcggatattggttttaacgcagaggcagcctggtcagaacaacaggttgccgcgccgaaacagcgcgaacgtcagcgcatcgtgattgaaggcgacggcgaagaacagatcgccgcatttgctgaaaatcttcgcaaagtcatttaattacaggggatgctatgaacacgttttctcaagtctgggtattcagcgataccccttctcgtctgccggaactgatgaacggtgcgcaggctttagctaatcaaatcaacacctttgtcctcaatgatgccgacggcgtacaggcaatccagctcggcgctaatcatgtctggaaattaaacggcaaaccggacgatcggatgatcgaagattacgccggtgtcatggctgacactattcgccagcacggcgcagacggcctggtgctgctgccaaacacccgtcgcggcaaattactggcggcaaaactgggttatcgccttaaagcggcggtgtctaacgatgccagcaccgtcagcgtacaggacggtaaagcgacagtgaaacacatggtttacggtggtctggcgattggcgaagaacgcattgccacgccgtatgcggtactgaccatcagcagcggcacgttcgatgcggctcagccagacgcgtcacgcactggcgaaacgcacaccgtggagtggcaggctccggctgtggcgattacccgcacggcaacccaggcgcgccagagcaacagcgtcgatctcgacaaagcccgtctggtggtcagcgtcggtcgcggtattggcagcaaagagaacattgcgctggcagaacagctttgcaaggcgataggtgcggagttggcctgttctcgtccggtggcggaaaacgaaaaatggatggagcacgaacgctatgtcggtatctccaacctgatgctgaaacctgaactgtacctggcggtggggatctccgggcagatccagcacatggttggtgctaatgcatcgcaaaccattttcgccatcaataaagataaaaatgcgccgatcttccagtacgcggattacggcattgttggtgacgccgtgaagatccttccggcgctgaccgcagctttagcgcgttgatccactctggcagggctgcattttggccctgccgctgacagggagctcttatgtccgaagatatctttgacgccatcatcgtcggtgctgggcttgccggttcggttgccgcactggtgctcgcccgcgaaggggcgcaagtgttagttatcgagcgtggcaattccgcaggtgccaagaacgtcaccggcgggcgtctctatgcccacagcctggaacacattattcctggtttcgccgactccgcccccgtagaacgcctgatcacccatgaaaaactcgcgtttatgacggaaaagtcagcgatgactatggactactgcaatggtgacgaaacctcgccatcccagcgttcttactccgttttgcgcagtaaatttgatgcctggctgatggagcaggccgaagaagcgggcgcgcagttaattaccgggatccgcgtcgataacctcgtacagcgcgatggcaaagtcgtcggtgtagaagccgatggcgatgtgattgaagcgaaaacggtgatccttgctgatggagtgaactccatccttgccgaaaagctggggatggcaaaacgcgttaaaccgacggatgtggcggttggcgtgaaggaactgatcgagttaccgaagtcggtaatcgaagaccgttttcagttgcagggtaatcagggcgcggcttgtctgtttgcgggatcacccaccgatggcctgatgggcggcggcttcctttataccaatgaaaataccctgtcgctggggctggtttgtggtctgcatcatctgcatgacgcaaaaaaatcggtgccgcaaatgctggaagatttcaaacaacatccggccgttgcaccgctgatcgcgggtggcaagctggtggaatattccgctcacgtagtgccggaagcaggcatcaacatgctgccggagttggttggtgacggcgtattgattgccggtgatgccgccggaatgtgtatgaacctcggttttaccattcgcggtatggatctggcgattgccgccggggaagccgcagcaaaaaccgtgctttcagcgatgaaaagcgacgatttcagtaagcaaaaactggcggaatatcgtcagcatcttgagagtggcccgctgcgcgatatgcgtatgtaccagaaactaccggccttccttgataacccacgcatgtttagcggctacccggaactggcggtgggcgtggcgcgtgacctgttcaccattgacggcagtgcgccggaactgatgcgcaagaaaatcctccgccacggcaagaaagtgggcttcatcaatctgatcaaggatggcatgaaaggagtgaccgttttatgacttctcccgtcaatgtggacgtcaaactgggcgtcaataaattcaatgtcgatgaagagcatccgcacattgttgtgaaggccgatgccgataaacaggccctggagctgctggtgaaagcgtgccccgcaggtctgtacaagaagcaggatgacggcagtgtgcgcttcgattacgccggatgtctggagtgcggcacctgtcgcattctggggctggggtcggcgctggaacagtgggaatacccgcgcggcacctttggtgtggagttccgttacggctgatgttggtttgatacgtaacgccgtactgactctcattgcaaaaaaacaggaataacccatgcaaccgtccagaaactttgacgatctcaaattctcctcaattcaccgccgcattttgctgtggggaagcggtggtccgtttctggatggttatgtactggtaatgattggcgtggcgctggagcaactgactccggcgctaaaactggacgctgactggattggcttgttgggcgcgggaacgctcgccgggctgttcgttggcacatcgctgtttggctatatttccgataaagtcggacggcgcaaaatgttcctcattgatatcatcgccatcggcgtgatatcggtggcgacgatgtttgtttcatcccccgtcgaactgttggtgatgcgggtacttatcggcattgtcatcggtgcagattatcccatcgccacctcaatgatcaccgagttctccagtacccgtcagcgggcgttttccatcagctttatcgccgccatgtggtatgtcggcgcgacctgcgccgatctggtcggctactggctttatgatgtggaaggcggctggcgctggatgctgggtagcgcggcgatcccctgtttgttgattttgattggtcgattcgaactgcctgaatctccccgctggttattacgcaaagggcgagtaaaagagtgcgaagagatgatgataaaactgtttggcgaaccggtggctttcgatgaagagcaaccgcagcaaacccgttttcgcgatctgtttaatcgccgccattttccttttgttctgtttgttgccgccatctggacctgccaggtgatcccaatgttcgccatttacacctttggcccgcaaatcgttggtttgttgggattgggtgttggcaaaaacgcggcgctggggaacgtggtgattagcctgttctttatgctcggctgtattccgccgatgctgtggttaaacactgccggacggcgtccattgttgattggcagctttgccatgatgacgctggcgctggcggttttggggctgatcccggatatggggatctggctggtagtgatggcctttgcggtgtatgcctttttctctggcgggccgggtaatttgcagtggctctatcctaatgaactcttcccgacagatatccgcgcctctgccgtgggcgtgattatgtccttaagccgtattggcaccattgtttcgacctgggcactgccgatctttatcaataattacggtatcagtaacacgatgctaatgggggcgggtatctcgctgtttggcttgttgatttccgtagcgtttgccccggagactcgagggatgtcactggcgcaaaccagcaatatgacgatccgcgggcagagaatggggtaaattgttcagatttctctcttttctgaatcaatattattgactataagccgcgtgaatatatgactacactttgtgggaaaacaaaggcgtaatcacgcgggctacctatgattcttataatttatgcgcatccgtatccgcatcattcccatgcgaataaacggatgcttgaacaggcaaggacgctggaaggcgtcgaaattcgctctctttatcaactctatcctgacttcaatatcgatattgccgccgagcaggaggcgctgtctcgcgccgatctgatcgtctggcagcacccgatgcagtggtacagcattccaccgctcctcaaactttggatcgataaagttttctcgcacggctgggcttacggtcacggcggcacggcgctgcatggcaaacatttgctgtgggcggtgacgaccggcggcggggaaagccattttgaaattggtgcgcatccgggctttgatgtgctgtcgcagccgctacaggcgacggcaatctactgcgggctgaactggctgccaccgtttgccatgcactgcacctttatttgtgacgacgaaaccctcgaagggcaggcgcgtcactataagcaacgtctgctggaatggcaggaggcccatcatggatagccatacgctgattcaggcgctgatttatctcggttcggcagcgctgattgtacccattgcggtacgtcttggtctgggatcggtacttggctacctgatcgccggctgcattattggcccgtgggggctgcgactggtgaccgatgccgaatctattctgcactttgccgagattggcgtggtgctgatgctgtttattatcggcctcgaactcgatccacaaaggctgtggaagctgcgtgcggcagtgttcggcggtggcgcattgcagatggtgatttgcggcggcctgctggggctgttctgcatgttacttgggctgcgctggcaggtcgcggaattgatcggcatgacgctggcgctctcctctacggcgattgccatgcaggcgatgaatgaacgcaatctgatggtgacgcaaatgggtcgcagtgcctttgcggtgctgctgttccaggatatcgcggcgatcccgctggtggcgatgattccgctactggcaacgagcagtgcctcgacgacgatgggcgcatttgctctctcggcgttaaaagtggcgggtgcgctggtgctggtggtattgctggggcgctatgtcacgcgtccggcgctgcgttttgtagcccgctctggcttgcgggaagtgtttagtgccgtggcgttattcctcgtgtttggctttggtttgctgctggaagaggtcggcttgtcgatggcgatgggcgcgtttctggcgggcgtactgctggcaagctcggaataccgtcatgcgctggagagcgatatcgaaccatttaaaggtttgctgttggggctgtttttcatcggtgttggcatgtcgatagactttggcacgctgcttgaaaacccattgcgcattgtcattttgctgctcggtttcctcatcatcaaaatcgccatgctgtggctgattgcccgaccgttgcaagtgccaaataaacagcgtcgttggtttgcggtgttgttagggcagggcagtgagtttgcctttgtggtatttggcgcggcgcagatggcgaatgtgctggagccggagtgggcgaaatcgctgaccctggcggtggcgctgtcgatggcagcaacgccgattctgctggtgatcctcaatcgccttgagcaatcttctactgaggaagcgcgtgaagccgatgagatcgacgaagaacagccgcgcgtgattatcgccggattcggtcgttttgggcagattaccggacgtttactgctctccagcggggtgaaaatggtggtactcgatcacgatccggaccatatcgaaaccttgcgtaaatttggtatgaaagtgttttatggcgatgccacgcggatggatttactggaatctgccggagcggcgaaagcggaagtgctgattaacgccatcgacgatccgcaaaccaacctgcaactgacagagatggtgaaagaacatttcccgcatttgcagattattgcccgcgcccgcgatgtcgaccactacattcgtttgcgtcaggcaggcgttgaaaagccggagcgtgaaaccttcgaaggtgcgctgaaaaccgggcgtctggcactggaaagtttaggtctggggccgtatgaagcgcgagaacgtgccgatgtgttccgccgctttaatattcagatggtggaagagatggcaatggttgagaatgataccaaagcccgcgcggcggtctataaacgcaccagcgcgatgttaagtgagatcattaccgaggaccgcgaacatctgtcattaattcaacgacatggctggcagggaaccgaagaaggtaaacataccggcaacatggcggatgaaccggaaacgaaaccctcatcctaataaagagtgacgtaaatcacactttacagctaactgtttgtttttgtttcattgtaatgcggcgagtccagggagagagcgtggactcgccagcagaatataaaattttcctcaacatcatcctcgcaccagtcgacgacggtttacgctttacgtatagtggcgacaattttttttatcgggaaatctcaatgatcagtctgattgccgcgttagcggtagatcgcgttatcggcatggaaaacgccatgccgtggaacctgcctgccgatctcgcctggtttaaacgcaacaccttaaataaacccgtgattatgggccgccatacctgggaatcaatcggtcgtccgttgccaggacgcaaaaatattatcctcagcagtcaaccgggtacggacgatcgcgtaacgtgggtgaagtcggtggatgaagccatcgcggcgtgtggtgacgtaccagaaatcatggtgattggcggcggtcgcgtttatgagcagttcctgccaaaagcgcaaaaactgtatctgacgcatatcgacgcagaagtggaaggcgacacccatttcccggattacgagccggatgactgggaatcggtattcagcgaattccacgacgccgatgcgcagaactctcacagctattgctttgagattctggagcggcggtaattttgtatagaatttacggctagtgccggatgcgacgccggtcgcgtcttatccggccttcctatatcaggctgtgtttaagacgccgccgcttcgcccaaatccttatgccggttcgacggctggacaaaatactgcttatcttcccagcgcaggcaggttaatgacccaccccagcagcagccggtatccagcgcgtaaataccttccggcgtacctttgccttccagcgatgcccagtgaccaaaggcgatgctgtattcttcagcgacagggccaggaatcgcaaaccacggtttcagtggggcaggggcttcttccggcgattctttgctgtacatatccagttgaccgtttggaaagcaaaaacgcatacgggtaaaggcgttggtgataaaacgcagtcttcccagcccccgcaattccggtgaccagttatttggcatatcgccgtacatagcgtcgagaaagaagggataggagtcactcgatagcaccgcttctacatcgcgcgcgcactctttggcggtctgtagatcccactgcggcgtgatccctgcgtgggccatcaccaactttttctcttcgtcgatttgcagcaaaggctggcgacgcagccagttaagcagctcgtcggcatccggcgcttccagcagcggtgtcaggcgatctttcggtttattgcggctgatcccggcaaataccgccagcagatgcagatcgtgattgcccagcaccagacgtacgctgtcgcctaaggatttcacatagcgcagaacatccagcgaacccggcccgcgcgcgaccagatcgcccgtcagccagagggtatctttcccaggggtaaattctactttatgcagcaatgcgatcagttcatcgtaacaaccatgaacgtcgccaataaggtatgtcgccatattcttttaatgaatgagtgtgggaacggcgagtcggaatacgggaatgtcgatgctgaaagggacgccattttcatcgatcatttcgtagtgaccctgcatggtgcccagcggggtttcaatgattgcaccgctggtgtactggtactcttcgccaggcgcgataagtggctggacgccaaccactccttcgccctggacttcggtttcacggccattgccattggtgatcagccagtaacgccccaacaactgcactggcgctcgccccagattgcgtatggttacggtataagcaaaaacgtaacgttcattatcaggtgaagattgtgcctcaatgtagacgctttgaacctgaatacacactcggggcgaattgatcatcgttaactctcctgcaaaggcgcgttctccgccagatagttcgccatctggcaatattgcgcgacagagatattttccgctcgcatcgccgggtcgatccccattcccgttaacacctcgacgctaaacaggttgccgaggctgttacgaatggttttacgacgctggttaaaggcttcggtggtgatgcggctcaacacacgaacatctttaaccgggtgaggcatcgttgcatgaggaaccaggcgcacgacggcggaatccactttgggtggtggtgtaaaggctgacggcggaacttccagtaccgggatcacgttgcaatagtattgcgccatgacgcttaatcgaccatacgctttgctgttcggtcctgcaaccagacgattcaccacctctttttgcaacataaagtgcatgtcggcaatggcatcagtatagctaaacagatggaacatcaacggcgtggagatgttataaggcaggttgccgaaaacacgcagcggctgacccattttctcggccagttcgccaaagttaaaggtcatcgcatcctgctgataaatcgtcagtttcgggcctaagaatggatgcgtttgcagacgtgccgccagatcgcggtcaagttcgatgaccgtcagctggtccagacgttcgccgaccggctcggtcaatgccgccagaccggggccgatttcgaccattgcctggcccttttgcgggttaatggcagaaacaatgctgtcgatcacgaactgatcgttgagaaagttttgcccgaagcgtttacgggctaagtggccctggtggactcgattattcattgggtgttaacaatcattttgatggcgagattaagcgccgtaataaaactgccgacatcggcttcgccacgtcccgccagttcaagcgcggtgccgtggtccactgatgtgcgaataaagggcaggcccagcgtaatgttcacaccgcgcccgaagccctggtattttagcacgggaagaccctgatcgtggtacatcgccagcacggcgtcggcgttatcgagatatttcggctgaaacagggtatcggcaggcagaggcccgttgagtttcatcccctgcgcccgcagctcgtcgagcaccggaataatggtgtctatctcttccgtacccatatgaccgccttcgcccgcgtgcggattcagcccgcagaccagaatgcgcggttcggcaataccaaattttgtacgcaaatcgtgatgtaaaatagcaatcacttcgtgcaaaagtgcaggggtgatagcatctgcgatatcgcgcagcggtaaatgcgtcgttgccagcgccacgcgaagttcttcggtcgccagcatcatcaccacttttttcgcctgcgaacgctcttcgaaaaactcggtatgaccggtaaacggaatgcctgcgtcgttaatgacgcctttatgcacggggcctgtgatcagcgcagcaaattcaccgttcagacagccatcacacgctcgcgccagcgtctccaccacgtaatgcccattttcaatcgctaactgccccgcagtgacagattcacgtagcgcgacaggaagtagcgttaatgtgcccgtagtttgcggttgtgcaggggagttgggggaataagggcggagggtgagcggcaaaccgagcatcgctgcccggtcggtaaggagagtggcatcggcacaaacaaccagttcgaccggccactcacgctgtgcaagctggacaactaagtccgggccaatcccggcgggctcgccgggagtgatcacaacacgttgggttttaaccattagttgctcaggattttaacgtaggcgctggcacgttgttcctgcatccagcttgctgcttcttccgagaacttacggttcatcagcatgcggtatgcacgatctttctgcgcagcgtcggttttatcgacattacgggtatccagcagttcgattaaatgccagccgaatgaagagtgaaccggtgcactcatttgacctttgttcaggcgagtcagggcgtcacggaaggccggatcgaaaacatctggtgtagcccagccgagatcaccgccctggttagcagagcctggatcctgagagaactctttcgctgcggcagcaaaagtcgttttaccactcttgatatcagcagcaatctgttccagtttcacacgggcctgttcgtcagtcatgatcggcgacggtttcagcagaatatggcgagcatgaacttcggtcaccgagatatttttgctttcgccgcgcaggtcgttaactttcagaatatggaagccaacgccggaacgaatcgggccaacaatgtcgcctttcttcgcggtgcttaatgcctgggcgaagatccccggcaactcctgaatacggccccagcccatctggccgccgttcagcgcctgctggtcggcagaatgagcaatcgccaacttaccgaaatcagcgccgttacgcgcctgatcgacaatggcacgcgcctggctttccgcttcgttcacctgatcagaggtcgggttttccggcagcgggatcaggatgtggctcaggttcagctcagtgctggcgtcgttttggttacccacctgctgcgccagggattcgacttcctgcggcaggatggtgatgcgacgacgcacctcgttgttacgcacttcagagataatcatctctttgcggatctggttacgataagtgttgtagttcagaccatcgtaagccagacggctgcgcatctgatccagcgtcatgttgttctgtttcgcgatgttagcaatcgcctgatccagctgctcatcggagattttcactcccattttctgccccatctgcaggatgatttgatccatgatcaaacgttccatgatttggtggcgcagcgtcgcgtcatcaggaagttgctgccttgcctgagcagcgttcagttttaccgactgcattaatccatcaacgtcgctttccagcacgacgccgttattgacgacggctgcgactttatcgactacctggggggcagcgaaactggtattcgcgatcatggcgataccgagaagcagcgttttccagttcttcatactttttccatttcaattaaccgcactgcggattacgtggtaaatcaacaaatcacaaagtgttttgatacggcagaatgttcgaacgcagcatctcttgcgtacccagaccgtagttggagctcaggccgcgaagttcgatgttaaagccgattgcgttgtcatataccgcatgttgtttatcgttatcccaaccgttcagcttccgctcgtaaccgacgcgaattgcatagcagcaggagctgtattgcacacctaacatagagtcggcttgcttgttcgcattggtgtcgtagtagtaggccccaacaatggaccaacgatcggcaattggccagctggcgacagcacctacctgcgaaataccattcttatattgctcagcagtggaatagtacttaggcagcgtagcctgaatatattccgggctggcgtaacggtaattcagctgtaccagacggtcttcatcccgacggtattcaatgctggagttactggtcgctacgttatccagacgtgtatcgtactgaatcccgccacgcaatccccaacgctcggagatacgccagtaagtatcgcctgcccacaccagtgaacccgttttgtcgtcattctcccatgttatgttgtcatcgccagtgcgagactccgtgaaatagtagatttgaccaacggaaatattaaaacgttcaacggcagcatcatcatatatgcgagatgtgacaccggtcgtcacctggttagcggaggcaatacggtcaagaccgccgtaagtccggtcccggaacaggccagagtagtcagattgcagcagagacgagtcgtagttatagatgtcgctctgatcgcgatacggcacgtacaaatactgcgcgcgcggttccagcgtttgggtataacccggagccagcatttccatatcgcgttcaaagaccattttgccgtcaactttgaattgcggcattacgcggttaacggattcgtccagcttggtcgtgtttctggagttataccagtcaagattggtttgctgataatgggttgccagcaacttcgcttcggtattgatgctgccccagttattagagagcggcaaattgatggtcggttccaggtgaacacgggttgcttcaggcatgtcgtctctggtgttaacaaagtgcactgcctggccgtaaatacgcgtatcaaacggaccaacatcattctggtagtaattaacgtctaactgcggctctgccgagtagctactggtgttctgttcgctgaaaacctggaactgcttggttgaaacggtggcattgaagttttgcaccgcatagccaacgctgaatttttgcgttgcgtagccgtcagtactggaaccgtacttgttatcgaaatcattgaagtagctaggatcgctgaccttggtgtagtcgacgttgaaacgccacacttgatccatgaccccggagtggttccagtagaataaccaacgacgtgaactgtcatcgttcgggtgttcatcttcatagactttatctgaaggcagatagtccagttccatcaagccagcgcccgcctgggagaggtagcggaattcgttctcccacatgatgttgccacgacgatgcatataatgcggcgtgatggtggcatccatatttggcgcgatgttccagtaatatggcaggtagaactcaaagtagttggtggtggtgtacttggcgttcgggatcaagaaaccagagcgacgtttgtcacccaccggcaactgcaaataggggctataaaagatcggtaccggacccaccttaaagcgggcgttccagatctccgcaacttgttcttcgcggtcatgaataatttcgctacctaccacgctccaggtgtcagaacccggcagacaggaggtaaagctaccgttatccagaatggtatagcggttttcgccacgttgtttcatcaggtccgctttaccgcgaccctggcgacccaccatctggtaatcaccttcccagacgttggtatctttggtgttcagattcgcccagcctttcggccctttgaggatcacctggttatcgtcgtaatggacattaccgagcgcatcaacggtacgtaccggctccggttgtcctggtgcctctttttgatggagctgcacttcgtcggcctgcagacggctgttaccctgcatgatatccacgctgccagtaaacacggcgtcatccgggtagtcccctttcgcgtggtcagcattgatagtcacgggtaagtcattggtatcgccctgtaccagaggacggtcatagcttggcacgcccaacatgcactgtgaggcgaggtcggctgccagtccctgttgactataaagggcggtggcaatcatggtggccaggagagtggggatacgttttttcatacgttgattttattgttccatcatcggtaacgttgcgcgtgacaaacggtcagagactaacgtactcgtcatctctacgctagtgttaatcctgtccgaatagcgtcagtggtgttaggcacggcattgaatgacaggtatgataatgcaaattataggcgatgtcccacaattgaccgcagccggaaaacggtaaaagcacctttatattgtgggagatagccctgatatccgtgtgtcgatttggggaatatatgcagtattggggaaaaatcattggcgtggccttggccttactgatgggcggcggcttttggggcgtagtgttaggcctgttaattggccatatgtttgataaagcccgtagccgtaaaatggcgtggttcgccaaccagcgtgagcgtcaggcgctgttttttgccaccacttttgaagtgatggggcatttaaccaaatccaaaggtcgcgtcacggaggctgatattcatatcgccagccagttgatggaccgaatgaatcttcatggcgcttcccgtactgcggcgcaaaatgcgttccgggtgggaaaatcagacaattacccgctgcgcgaaaagatgcgccagtttcgcagtgtctgctttggtcgttttgacttaattcgtatgtttctggagatccagattcaggcggcgtttgctgatggttcactgcacccgaatgaacgggcggtgctgtatgtcattgctgaagaattagggatctcccgcgcccagtttgaccagtttttgcgcatgatgcagggcggtgcacagtttggcggcggttatcagcagcaatctggcggtggtaactggcagcaagcgcagcgtggcccgacgctggaagatgcctgtaatgtgctgggcgtgaagccgacggatgatgcgaccaccatcaaacgtgcctaccgtaagctgatgagtgaacaccatcccgataagctggtggcgaaaggtttgccgcctgagatgatggagatggcgaagcagaaagcgcaggaaattcagcaggcatatgagctgataaagcagcagaaagggtttaaataagttttaaactgtaggcctgataagacgcggcccgcgtcgcatcaggcaatcggcgcacaattgccggatgcggcgtgaacgccttatccgcctaccgaactgcgccagcgtgacgattaaaaatccgctggcgctttaaacgtcatactattgccatacgccggatgggtaatcgtcaacatctctgcatgtagcaacaaacgcggtgccatcgctctcgcttctggtgatgcataaaaacgatcgccgagaatcggatgccccagcgccagcatatgcacacgcaattgatgcgaacgcccggtaatcggttttaacaccactcttgccgtgttatccgccgcatactccaccacttcatattccgtctgcgcaggtttacccgtttcgtaacagactttctgtttcgggcggtttggccagtcgcaaatcagaggcagatccaccagaccttctgcgggggatggatgcccccagacgcgggccacatactgctttttcggctcgcgctcgcggaactggcgttttaactcccgctccgcggctttggtcagcgccactacaatcacgccgctggtagccatatccagacgatgcaccgattctgcctgcggataatcacgctgaatgcgcgtcatcacgctgtctttgtgctcttccagacgacccggcaccgacaacaaaccgctcggcttgttgaccaccataatatggtcatcctgatacaggataaccaaccagggttcctgcggtggattgtagttttccatccccattttcggctccgttactgatgcgttacaacgatcaaacgcagggcatccagacgccaacctgcctgatccaggctttccattacctgctgacggttgctctcaatggcggtcagttcgtcgtcacgaatgttcgggttcactgcacgcagagcttccagacgagacagctcggcagacagtttttcgtcggcttcgttacgcgctgcatcaatcaatgcacgggcagatttctcgatctgcgcttcacccagttgaaggatagcgtgaacatcctgctgcacggcgttaaccagtttgctgccggtgtgacggttaaccgcgttaagctggcggttaaaggtttcaaactctacctgcgccgccaggttgttgccgtttttatccagcagcatacgtaccggcgtcggtggcaggaagcggttgagctgcaactgcttcggagcctgggcttcaaccacataaatcagttccaccaacagcgtacctaccggcaacgctttgttttttaacagtgaaatcgtgctgctaccggtatcgccagaaagaatcagatccagaccgttgcggatcagcggatgctcccaggtaataaactgtgcatcttcacgcgccagcgccacttcacgatcaaaggtgatggtgatgccatcttccgacaggccagggaagtccggcaccagcatatgatcggacggcgtcagcacgatcatgttgtcgccgcgatcgtcctgattgataccgataatatcgaacaggttcatggcgaaggcgatcaggttggtatcgtcatcctgctcttcaatgctttctgccagtgcctgggctttttcgccaccgttggagtggatttccagcaggcggtcacgaccctgttccagctgtgctttcagcgcttcatgttgctcgcggcagtttttgatcagatcgtcaaagccttcggtttgatccggtgaagccagatagttaatcagaccgttgtatacgctatcgtaaatagtgcgtccggtcgggcaggtgtgctcaaatgcatccagaccttcgtgataccagcgcaccagcaccgactgagcggttttctccagataaggcacatggatctgaatatcgtgcgcctggccgatacgatccagacgaccaatacgctgctccagtagatccgggttgaatggcaggtcaaacatcaccatgtggctggcgaactggaagttacgtccttcagaaccgatttctgagcacagcagtacctgtgcgccggtgtcttcttcggcaaaccaggcggcagcgcggtcacgttcgataatcgacataccttcgtggaacaccgcagcgcgaataccttcacgttcgcgcagtacctgctccagttgcagcgcagtggcagctttggcgcagatcaccagcactttctgagagcgatggctggtcaggtagcccatcagccactcaacgcgcggatcgaagttccaccaggtggcgttatcaccttcaaattcctgataaatacgctccgggtagagcatatcgcgagcacgatcttccgcacttttacgtgcgcccataatgccggagactttaatagccgtctgatactgcgtcggtagcggcagtttaatggtgtgcagctcgcgtttcgggaatcctttcacaccgttacgcgtgttacggaacagcacgcggctggtgccgtggcgatccatcagcatcgaaaccagctcctgacgggcgctctgggcatcttcgctgtcgctgtttgctgcctgcaacagcggctcgatatcctgctcgccgatcatctcgccgagcatgttcagttcgtcattgctcagtttgttacctgccagcagcatggcaacggcgtccgcaaccggacgataatttttctgctcttcaacgaactgcgcaaaatcgtggaaacggttcgggtccagcagacgcagacgggcgaagtggctttccatccccagctgttccggggtcgcggtcagcagcagaacgcccggcacgtgctctgccagttgttcaatggcctgatattcacggcttggcgcatcttcgctccacaccaggtgatgcgcttcatcgaccaccagcaggtcccattcggcttcacagagatgttccaggcgctgtttgctacgacgggcaaaatccagcgagcaaatcaccagctgttcggtgtcaaacgggttgtaagcatcgtgctgagcttcggcataacgctcatcatcaaatagcgcaaagcgcaggttgaaacggcgcagcatttctaccagccactgatgctgtaaggtttccgggacgataattagcacacgttcagcagcgccagagagcagttgctgatgcaggatcatcccggcttcaatggttttccctaaacccacttcgtcagccagcaggacgcgcggcgcgtggcggcgaccaacatcatgagcgatgttgagctgatgcggaatcaggctggtacgctgaccgcgcaggccgctgtacggcatacggaactgttcgctggaatacttacgcgcgcgataacgcagcgcaaagcggtccatacggtcaatctgcccggcaaacagacggtcctgcggtttgctgaacaccagtttgctatcaaggaaaacttcacgcagggctacgccggactcttcagtatccaggcgagtaccgatataggtcagcaagccattttcttcttttacttcttcgacttgcatctgccagccgtcatggctggtaatagtatcaccagggttgaacatcacgcgggtcacgggggaatcactgcgtgcgtacagacggttttcaccagtagatgggaaaagtaaagtgacagttcgcgcatccaccgcgacaacggttccaagtcccaattcgctttctgtatcgctgatccagcgttgaccaagtgtaaaaggcatatgtgttcggctctatatctttaattgcaggcaataaccacccgctaccgtgcttatgaggtagtggtgttattcaggtccaggaatggaaagggcgctatggtactggatggcaaagcattcgtcacgcatcaaaatggtatctggcgaactcttttttttgctcaaaatagcccaagttgcccggtcataagtgtagcaaaattatcctcaataaaaggaagtattccctccgccacgggttgtagctggcgggtcagatagtgttcgtaatccagtggtgaacgttggtagtccagcggctccgggccgttggtggtccatacgtacttaatggtgccgcggttctggtattgcaaggggcgacctcgcttttggttttcttcatcggcaaggcgagcggcgcgtacatgaggcggaacattacgctgatattcgctcagcggacggcgaaggcgtttacggtaaaccagccgcgcatccagttcacccgccatcagtttgtcgatggtttggcggacgtactcctgatatggctcgttgcggaagatacgcaggtacagctcctgctgaaactgctgggccagcggcgtccagtcggtgcgcacggtttccagccctttaaacaccatccgctgcttgtcgccctcctgaatcagcccggcgtagcgctttttactgccggtatcagctccgcgaatggttggcataagaaaacggcagaaatgagtttcatactccagttctaatgcgctggtcagccgttgtttttgcagcgtttccgcccaccaggcgttaacgtgctgcaccagtgcacgaccgattttcgccgcctcttcttccgaatgtgcaccttttagccagacaaaagtcgagtcggtatctccgtagataacgtcgtagccctgcgcttcaatcaatgctttggtttgccgcatgatctgatgaccacgcatggtgatcgacgatgccaggcgcggatcgaaaaagcggcaggcggtggtgccaagcacgccataaaaggcattcataatgatcttcagcgcctgcgaaagtggtttattaccctgacgtttggcttcatcgcgcccgtgccagatgttagtcacaatctccggcaggcaatgtttctcccgtgagaaccaggcatcgagaaaaccttcggtactgtgctctggatcaggctgcgccatgccttcaaccagcccgacgggatcaatcagaaaggtgcggatgatcgacgggtacaggcttttatagtccagcaccagcactgaatcataaagccctggccgtgaatccatcacgtagccgccagggctggcgtgcggcggcacttcgcctagattaggcgcgacataaccagcgcgatgcattcgcggaaaatagagatgaccaaacgctgccaccgaaccgccgtgccgatccaccggcaggccgttcaccgttgctcgttcgagtaaaaatggcatgatttcagttttgtggaagatctgcgtcaccagctcgcaatctttcaggttataagttgccagcgcaggtttatcttcggcgaaacggcggtcaatttcgtccattcgatcccacgggttatcgatagattttccttcgcctaatagctcctgagcgacagtttccagcgagaatgaagagaaattccagaacgcggatttcagcgcctcgataccgtcgataattagccgacctttagcctgggcaaaaaagacgccgtttttaaagccgtgctcgcgccactccagctcgctattatcgcgcccaagacgcagcggaagacggtaacgctcggcatgtttttgcagcattcgcagatcgaactgcaccacgttccaaccgatgatcacatcaggatcgtagttggcaaaccaggcgttgagtttttccagcaactgcgggcggctggcgacgtattccagttcgaaatcaagcgaggaggcgtcgccattctccggccccagcatataaacgatgcgctgcccgcagccttccaggccgatgcagtacagctcaccgtggcgggtggtttcaatatctatagaaacccacttgagcggcggacgatagtcgggatgcggtttcagacgggcattaacgatagtgccattgtgcatatcaccctcgacccacaccggtgaggtgataaaccgctccatcagatagcgttctggcgggcgcacatcggcctcgtagacggtaacgccaccttcacgcaggcgcttttcgtaattcatcaattggcgatgggcgcgacagtaaaggccatacaccggctggcggtgaaaatcctttaacgccagcggtgtcaggcgaaagccttgttcaccctgcaaaatatgctgagcgcggggaacctgatcggcgggaataaacgccacggactcttgcggtgcaagcgtaacctgcaacggcccgttgtccgtcgccagccagaaggagacttctgtcccttgcggggtgtcccgccagtgtcgggttaagataaaacctgcctgcgccacgctgaaaatccatcaaaaaaccaggcttgagtatagcctggtttcgtttgattggctgtggttttatacagtcattactgcccgtaatatgccttcgcgccatgcttacgcagatagtgtttatccagcagcgtttgctgcatatccggtaactgcggcgctaactgacggcagaatatccccatataagcgacctcttccagcacgatggcgttatgcaccgcatcttcggcatttttgccccatgcaaacgggccgtgggaatggaccagaacgccgggcatttgcgctgcatcgataccctgtttttcaaaggtttctacgatgacgttaccggtttcccactcatattcgccgttgatttctgcgtcggtcattttgcgggtgcagggaatggtgccgtagaaatagtcggcgtgggtggtgccggttgctggaatcgactgacccgcctgcgcccagatggtggcgtggcgcgagtgcgtatgcacaatgccgccaatggaggggaatgcctgatagagcagccggtgagttggcgtgtcggaggagggctttttcgtaccttcaaccacttcaccggtttcgatgctaaccacgaccatatcgtcagcggtcatgacgctgtaatcgacgccggaaggtttgatcacaaagacgccgcgctcgcgatcaacggcgctgacgttgccccatgtgagcgtgaccaggttgtgttttggcagcgccaggttggcttctaatacctggcgtttgagatcttctaacatgttgactcctgagaggtcgtttcccctcaccccggccctctccccaaaggggcgagggggaaaacaatgccggatgcgctttgcttatccggcctacaaaatcgcagcgtgtaggccagataagacgcgtcagcgtcgcatcaggcgttacatacctgatgtggctacttagcgacgaaatccgtaatacacttcgttccagcgcagtgcgtctttaaacgctggcaggcgggtgtcgttatcaatcaccgtgatttcaatgtcgtgcatctcggcgaactggcgcatatcgttgaggttcagcgcatggctgaagacggtatggtgcgcgccaccagcaaggatccacgcttcggaagcagttggcagatccggttgcgctttccacagcgcattcgccaccggcagtttcggcagggagtgcggtgttttcaccgtgtcgatacagttaaccagcagacggtaacgatcgccgagatcaatcaggctggcgacaatcgctggaccggtttgggtattgaagatcagtcgggcaggatcgtccttaccaccaataccgagatgctgaacgtcgaggatcggtttctcttctacggcaatcgacgggcagacttccagcatatgggagccgagcaccaggtcattacctttctcgaagtgataggtgtagtcctccataaaggaggtgccgccctgcagaccggttgacatcaccttcatgatgcgaagcagggcggcggttttccagtcgccttcgcccgcaaagccgtaaccctgctgcatcagacgctgtacggccagacctggaagctgtttcagaccgtgcaaatcttcaaaggtggtggtgaacgcgtggaagccaccttgttccaggaaacgcttcatccccagctcaatacgcgccgcttccagcacgttctgtcgtttttcgccgtggatttgtgtggcaggcgtcatggtgtagcagctttcgtactcatcgaccagcgcgttaacatcgccgtcgctgatggagttcaccacctgcaccagatcgccaaccgcccaggtattgacggagaaaccgaacttgatctgtgcggcaactttatcaccatcggtgaccgctacttcacgcatgttatcgccaaaacggcagactttcagatgacgggtatcctgtttagagaccgcctggcgcatccaggagccgatacgctcatgggcttgtttatcctgccagtgaccggtaaccacggcatgttgctgacgcatacgcgcgccaatgaagccgaactcgcgaccgccatgtgcagtctggttcaggttcataaagtccatatcgatactgtcccacggcagcgccgcgttaaactgggtgtggaattgcagcaacggtttgttgagcatggtcaggccgttgatccacattttggccggggagaaagtgtgcagccacaccaccagaccagcgcaacgatcgtcgtaattcgcgtcgcggcaaatagcggtgatttcatccggcgtggtgcccagcggtttcaacactagtttgcagggcagtttcgcttccgtattcagcgcattaacaacgtgctcggcatgttgggtgacctgacgcagggtttccgggccatacagatgctggctgccaatgacaaaccacacttcataattatcaaaaatcgtcattatcgtgtccttatagagtcgcaacggcctgggcagcctgtgccggggcggaagttggaagatagtgttgttcggcgctcatcgcccattgctgatagcggcgataaagctgttcaaagcgttgtgcctgttcgctgcgcggttgcagggttttctctaccgcactggccattttttgctgggctgatgggatgtctgcgtgcactttcgcggcgacggcagcaaaaatcgccgcaccgagcgcacagcactggtcagaggcaacaatttgcagcgggcgattcagcacgtcgcagcaggcctgcataatgacctggtttttccgcgcgatgccgcccagcgccatcacgttattgacggcgatcccctgatcggtaaagcactccatgattgcgcgtgcgccaaaggcggtggcagcaatcaaaccgccgaacagcagcggagcgtcggtagcgaggttaagatcggtaatcacccctttcaggcgttggttagcgttcggtgtgcggcggccgttaaaccagtcgagcaccaccggcaggtgatccagagacggatttttggcccatgcttcggtcagcgccggaagcagttgtttctggctggcgttgatttgcgctttcagttccggatgctgggcggcaagctgttccagcggccagccgagtacgcgaccaaaccaggcgtagatatcaccaaacgccgattggcctgcttccagaccgataaatccaggtaccacgctgccatcaacctgaccgcaaatacctttcactgcccgctcgccaacgctctgtttgtcggcaatcagaatgtcgcaggtggaagtaccgataacttttaccagtgcgttaggctgtgcgcctgcgccaactgcgcccatatggcagtcaaacgcgccgccggaaatcaccacgctttcaggcaggccgagacgctgcgcccattccgggcataaggtgcccaccggaatatcggcagtccaggtgtcagtgaacagcggggaaggcaaatggcgattgaggatcgggtccagctcatcaaagaaactggctggcggcaagccaccccagctttcgtgccatagcgacttatgcccggcgctgcaacgtccgcgacgaatatcctgcgggcgggtggtaccggaaagcagagctggcacccagtcgcacagctcaatccacgatgcggcagattgcgccacggcggtgtcctggcgagtcacatgcaggatttttgcccagaaccattcgctggaataaataccgccaatgtagcgggagtagtcaacgttgcccggcgcgtggcacaaacgggtaatctcttccgcttcttcaaccgcagtgtggtctttccacaatacgaacatcgcgttcgggttttcggcaaactccgggcgcagcgccagcacgttaccgtcggcatcaatcggtgcgggcgtcgagccggttgtgtcaacgccaatcccgaccacagctgcgcgctgttcgacgctaagctctgcaagcacggttttcagtgccgcttccattgactcaatgtagtcacgcggatgatgacggaactggttattcggggcatcacaaaattgccctttttgccaacggggataccactctacgctggtggcgatctcttcaccgctggcgcagtccaccgccaaagctcgcacagaatcactgccaaaatcgaggccaattgcaatcgccatcgtttcactccatccaaaaaaacgggtatggagaaacagtagagagttgcgataaaaagcgtcaggtaggatccgctaatcttatggataaaaatgctatggcatagcaaagtgtgacgccgtgcaaataatcaatgtggacttttctgccgtgattatagacacttttgttacgcgtttttgtcatggctttggtcccgctttgttacagaatgcttttaataagcggggttaccggtttggttagcgagaagagccagtaaaagacgcagtgacggcaatgtctgatgcaatatggacaattggtttcttctctgaatggcgggagtatgaaaagtatggctgaagcgcaaaatgatcccctgctgccgggatactcgtttaatgcccatctggtggcgggtttaacgccgattgaggccaacggttatctcgatttttttatcgaccgaccgctgggaatgaaaggttatattctcaatctcaccattcgcggtcagggggtggtgaaaaatcagggacgagaatttgtttgccgaccgggtgatattttgctgttcccgccaggagagattcatcactacggtcgtcatccggaggctcgcgaatggtatcaccagtgggtttactttcgtccgcgcgcctactggcatgaatggcttaactggccgtcaatatttgccaatacggggttctttcgcccggatgaagcgcaccagccgcatttcagcgacctgtttgggcaaatcattaacgccgggcaaggggaagggcgctattcggagctgctggcgataaatctgcttgagcaattgttactgcggcgcatggaagcgattaacgagtcgctccatccaccgatggataatcgggtacgcgaggcttgtcagtacatcagcgatcacctggcagacagcaattttgatatcgccagcgtcgcacagcatgtttgcttgtcgccgtcgcgtctgtcacatcttttccgccagcagttagggattagcgtcttaagctggcgcgaggaccaacgtatcagccaggcgaagctgcttttgagcaccacccggatgcctatcgccaccgtcggtcgcaatgttggttttgacgatcaactctatttctcgcgagtatttaaaaaatgcaccggggccagcccgagcgagttccgtgccggttgtgaagaaaaagtgaatgatgtagccgtcaagttgtcataattggtaacgaatcagacaattgacggcttgacggagtagcatagggtttgcagaatccctgcttcgtccatttgacaggcacattatgcaagcattgctggaacactttattacccaatctaccgtgtattcattgatggcggtggtgttggtggcctttctggagtcgctggcgctggtcggtttgattctacccggtacggtgctgatggcggggctgggagcgctgattggcagcggcgagttaagtttctggcacgcctggctggcagggattgtcggttgtctgctgggcgactggatctccttctggctgggctggcgttttaaaaagccgttgcatcgctggtcatttctgaagaaaaacaaagcattactcgataaaactgaacatgcgttgcatcaacacagcatgttcaccattctggtcggtcgctttgttggcccgacgcgtccgctggtgccaatggtggcgggaatgctggatctgccggtggcaaaattcattacgccgaatattatcggctgcctgctgtggccaccgttttacttcctgcctgggattctggcgggcgcggcgatcgatattccagccggaatgcagagcggcgagtttaaatggttgctgctggcgacggcggtatttttgtgggttggtggctggctgtgctggcggttatggcgcagcggtaaagcaaccgatcgtttaagtcattatttgtcgcgcggccgtttgttgtggctgacgccgttgatttctgccatcggcgtggtggcgctggtggtgttaattcgccacccgttgatgccggtgtatatcgatattttgcgtaaagtggttggggtttaggggattgtcttgtgcgggttgcctgatgcgacgctgaccgcgtcttatcaggcctacaaaacgcactgtccgtaggtcggataaggcgttcacgccgcatctgacagtgcatactaacccgtaatccccaatagtgctgaagcactcgccttaccgctcaacaactcattggtcttaccctgccaggcgatgcgcccgtcggcgaccaccaccgagcgcgtggcgatccgcgcggcatcttccacactgtgtgacaccatcaataacgtcattttttgctgctggcagctcgtgctcaccagcgtcaacatctcctggcgtagtgccggatcgagcgcagagaacggttcatcgagcaataaaatcggctgttcgcgtaccagacaacgtgctaacgccactcgctgtcgctgaccgccggaaagctcgccaggtaaccgcgccattaaattatcaatccccatctggcgggcgatagcgtgcattttctcctgctgtgccgcgttcagtttcaatcccggatttagccccagcccgatgttctgcgcgaccgtcaggtgactgaacaggttgttttcctgaaacagcatcgacaccggacggcgtgacggcggcgtcgtggtgtgatcaacgccgtcgatagtcagcgaaccgctggctggcgtcagaaaaccggcgatcaaattcagcagggtacttttacccgcgccgcttggcccgaggattgccacctgctcgccgcgttctaccgttaagctaaaacgcatcggcaaatggtgataaagccaggtgatatcagtcagttttaacatttcgccccggtagtttttcaatcacggtaaacagcagaaaacagagtagtagcagaattaacgcggtgaccgcaccgtcctggctgcgataggagccaatttgctggtagagataaaacggcagggtacggaaatcatcgttaccgaacaacgccactacgccaaaatcaccaatcgacagcacgcaggcaaaagccagcgcctgcgccagtggacgtttcagggcgcgcagctcgaccacttttaagcgcgaccagccttcaatgcccagcgactgacacaacatactgtagcgggcggtgatatcgcgcatcgggttttccagtactttcagcgcataagggatcgccattaacgcattggtgaaaatcacaatgccgtcagcagattgcggcaggccaatggtgttgttgagcagtaaaaagaagccggtagccagcacaatccccggcatggcgagaatcaacatgccgctcatctccagcgcctgacccgccagcattttctgccgcgcccgaagttcgcgactgctccatagcagcatcatggtcagcactacgcacaatacacctgccgccagcgcaatacgcaacgaggtccacagcgcctgccacagcaccggttgtgccagcacttccggcaactggcgatttagcccatcgacgatcaccgccagcaacggtggcagcaacagcagcagcgccagcacaattaacaccgtgtcgcaaatgcggctatgcagacgatcgtccgggtcgcgccagccttgcagcagcgtggtgcctggcgcaatggccttactcaatcgctgactcagcagcaccaacccgaggcaacacaccatctggatcagcgccagcatcgccgcgcgggcaggatcgtagtcgtaactcagcgcctgatagattgccagctcgatagtggttgcctgcggaccgccgcccagcgacagcacggtggcgaagctggcgaaacagagcataaagataagcgcggcaaccggcgggatttgtcgccgtagccacggccattcgatgaagcggaaaaaatgccagccgcgcatcccaagctgggcggcaagctgacgttgctcgccgggaatgttttccagtgcctggagtaataagcggctcgccatcggtagattaaaaaatacgtgcgccagcaaaataccttgcaggccgtagggcgaaaaggtccactccagaccgagcgattggcagagcgatgccagccagccctgacgaccatagacgctaagaatgccgaaaacagcaactagcaccgggaggatcaaggtcattgcgcacagacgcaacagcgccagccgacccggaaagcgcctgcgatagagggcgcgggcgaggaatatcgcgggtacgacagagagtagcgccgagagaaacgcctgccagaaggagaagcgcaccacatgccacaggtagctgtcctgccagactgccacccagttaccctgcggcgcgttccaccacagggcgagaaacgccgcgagcgcaaccgctaccaccagcgtggcggcgcttacacctggaattaaccagccgggaattaacggctgacggcgcgttgccattcgctaatccatgcctgacgttgtgccgccacttcggctggcgtgaactccagcgtggttgctggtttggtcaattgttcaaacccggcaggcagcgtgacatttgccaccggatacatccagttgccggttgggatcgcattctggaaagccggagaaaccataaactggagaaatttttgcgccagctccggctgcttgctggcagcggtgcgggcggcgacttccacctgcagatagtgaccttcgctaaagttcgcggcggcgtagttatcttttttctcttcgagaatgtgataagccggagaggtggtgtaactcagtaccagatcgctttcaccttttaaaaacaggccgtaggcttcgctccagcctttggtgacggtgacagttttcttcgccagtttctgccaggcctgcggggtgtcatcgccatagactttttgcatccacaacagcagacccagccccggcgtactggtgcgcggatcctgataaatcactcgccagttttgatcgctctcaaccagctctttcaggctttggggcgggtttttcagtttgttcttgtcgtagacgaaggcgaagtagccgtaatcaaacggtacgaaagtgtcattattccagccgccgggaacgttaatggcatccgctgccacgccgcttttggcaaacagtccggttttactggcggcgtctaacaggttgttatccagccccagaactacatcggctttgctgtttttgccttccatccgtagacggttgagaagcgaaacgccatcttccagcgccaccagtttcagttcgcaattacagtcggcttcaaaggcttttttaaccaccggaccaggcccccagtcggcggcgaaggaatcgtaggtataaacagtcagaacgggtttagcgaaaacgggcgctgtgcacagcaacagcaggggcagacatttttttaacactttgcacctcaaaaaagagtggcaaaggacttgagaaggagcctcaaatcccttcgccggcgttatccggatcaggttcgacgggtattttctcagcgcacgcgtttgcgtggcaccccgttgagaacggcgttagtgtagtgattttgttatcaaccagcaatcatggatccggtggcgcaaaccacgctgatttaaaatcgaaccagccgagggtgttcatgcgcaggccgcgcatactgcgttgcccctgaatgatcagccagtggtgcaataatggcaccatcgctttgctggcgaccagttgctggcaccagttcgccagattcatctcgccattgcgccagcgagcagcgtcggcttgccagtcaatgggaatgcaatgttgtagcagtggcacttcgcataaatgtgcgaaaacagagaagtccagcggcagggtaaagttggcgctgtttagccagatatcactttcgatctctcctgtatgccactgatcgtagtcgatctctttgatttccagcgtgacctggtgacttgccagaatctgctgcatgatcccggcaatcacccgatgctcactgtgatcctgataaaaggttagggtgaggctttccagaccagccggtttttcgctctttatggtgcgggcatggtgccaacgggggagcagtccataagccgggaaccacagttgctggtactgttcctcagcgaaatagaccagattagttggagaaagcacatagcttacccagtccctgacttgctgattcgccccgcgatgggtgcggctgtcgaatagtaaatagtagcaaccttcctccaggcggctttcaatctctttttcctcgccctgtggaccttttagcatcagacctccggctggctcgtcggcaatttccggcagaacccagacgttaacttcgtcgattaatgcccggtaaccgaagaagtcatcgaatgcctgaattttcagttgattggtgctgttgcggatcaccgcatacggaccggtgccgatgggatggctggcaaagttactgagggtttcccattcgcgcggcaggatcatcgccggaacttgccccagcaataacggtaaccagcggtccggttgcgtgagatggatatccagcgtccagggcgtcggcgacacaatgtcagcaatatgcgaatagagcggcagcgtattgattcgttttaaagaggcgatcacgtcgtccatttccagttcacgaccatgatgaaaatggactcctggacgcaaaaagaaacgccagcgaagcggtgatatttgctgccagtggtgggcgatgtctgcttccagttccccattttcctcatttatgcgcgttagcgaactgaagatttgccgggcaatatgggtttcggaacggcgcaatgcgctgccaggtagcagattacgcaacggacgatagtagagcacgcgcaggatgtgccgcccctggcggaagctgcggcccagatgagaaaccagcatttgccgcacagtcgctttgtcgccaaccaactgtactagttggtcgatacgatcctgctccagcaggtcttccgcccgctgttgctgaagcgccagcccggtatagaggaatgtcagacgcgagcgtttaccgcgcccgacttccgcttcccacgtcagccagccgcgatcctgcatggtgttgagcagggtacgcatatgacgacgcgagcagctcaataacgctgccagttcgttgagcgttgtgtcctgcgatttaccctcgcagcattgccacaggcggatgaactgttgttgcagacgagcagatggcataaaaggggaactcctgcgcaaaagacagcaattttattttccctatattaagtcaataattcctaacgatgaagcaaggaggtgccccatgcgtcagttttatcagcactattttaccgcgacagcgaagttgtgctggttgcgttggttaagcgtcccacaacgattaaccatgcttgaaggactgatgcagtgggatgaccgcaattctgaaagttgacttgcctgcatcatgtgtgactgagtattggtgtaaaatcacccgccagcagattatacctgctggttttttttattctcgccgcgctaaaaagggaacgtatgatctggataatgacgatggctcgccgtatgaacggtgtttacgcggcatttatgctggtcgcttttatgatgggggtggccggggcgctacaggctcctacattgagcttatttctgagtcgtgaggttggcgcgcaacctttctggatcggactcttttatacggtgaatgctattgctgggatcggcgtaagcctctggttggcaaaacgttctgacagtcagggcgatcggcgaaaactgattatattttgctgtttgatggctatcggcaatgcgctattgtttgcatttaatcgtcattatctgacgcttatcacctgtggtgtgcttctggcatctctggccaatacggcaatgccacagttatttgctctggcgcgggaatatgcggataactcggcgcgagaagtggtgatgtttagctcggtgatgcgtgcgcagctttctctggcatgggttatcggtccaccgttggcctttatgctggcgttgaattacggctttacggtgatgttttcgattgccgccgggatattcacactcagtctggtattgattgcatttatgcttccgtctgtggcgcgggtagaactgccgtcggaaaatgctttatcaatgcaaggtggctggcaggatagtaacgtacggatgttatttgtcgcctcgacgttaatgtggacctgcaacaccatgtacattattgatatgccgttgtggatcagtagcgagttaggattgccagacaaactggcgggtttcctgatggggacggcagctggactggaaataccagcaatgattctggctggctactatgtcaaacgttatggtaagcggcgaatgatggtcatagcagtggcggcaggagtactgttttacaccggattgattttatttcatagccgtctggcgttgatgacgctgcaactttttaacgctgtatttatcggcattgttgcgggtattgggatgctatggtttcaggatttaatgcctggaagagcgggggcagctaccaccttatttactaacagtatttctaccggggtaattctggctggcgttattcagggagcaattgcacaaagttgggggcactttgctgtctactggataattgcggttatttctgttgtcgcattatttttaaccgcaaaggttaaagacatttgatgacgtggacgatagcggaaagcccggtcatttgaccgggcaaggggattaattcataaacgcaggttgttttgcttcataagcggcaatggcgtcgtcgtgctgcaaggtaagcccaatactgtccagaccgttcatcatgcagtggcggcggaaggcatctatggtaaagtgataggttttctctcccgctttcacctcttgcgcttccagatccacgtcgaaatggatccccggattggctttcaccagcgcaaacagttcgtccacttctgcatcgcttaatttcaccggcagcagctggttgttaaagctattgccgtagaagatgtcagcaaaactcggcgcaatcaccactttaaaaccgtagtcggtcaatgcccagggcgcgtgctcacgcgaggagccacagccgaagttttctcgtgccagcaaaatggaagcgccctgatactgcgggaagttcagcacgaagtccgggtttggctgttggcctttttcatccagaaatcgccagtcgttaaacagatgcgcgccaaaaccagtacgggtcactttctgcaaaaactgtttcgggatgattgcatcggtatcgacattggcggcatccagcggaaccaccaggcctgtgtgtttgataaatttctctgccatggtgtgctccttatttaatgttgcgaatgtcggcgaaatggccggtcacagccgcggcggcagccattgccgggctgaccagatgcgtgcgcccgccgcgcccctggcggccttcaaagttacggttgctggtggaggcacaacgttcgcccggattcagccggtcgttgttcatcgccagacacattgagcagccaggtaagcgccattcaaaaccggcttcaataaagattttatccagaccttccgcttccgcctgggcttttaccgggccagagccgggaaccaccagtgcctgcacgcctggcgcgacttttcgccctttggcgatctccgctgccgcgcgtaaatcttcaatgcgcgagttggtacaggaaccgataaacactttgtcgatagccacttcggtcagcggaatacccggtttcagccccatataggccagcgctttttctgccgacgcacgttcaaccggatcggcaaacgaagccggatcgggaatattgtcgttcacggaaatcacctggccgggattggtgccccaggtgacctgcggtgaaatttcttctgcttgcagagtgacaacggtatcgaaagttgcgccttcgtcggtttgcagggttttccagtaggcaatggcgtcgtcgaaatctttgcctttcggcgcatgcagacggcctttgacatagttaaaggtggtttcgtccggtgcaaccagaccggcttttgcgcccatttcgattgccatattgcacagggtcatacgaccttccatgcttaaatcacggattgcttcgccgcaaaactccaccacatgcccggtgccgcctgcgctaccggttttaccgataattgccagcacgatatcttttgcggtaatgcccggcgcggctttgccctggacttcaattttcatggtttttgcgcggccctgtttcagggtttgcgttgccagtacgtgttcaacttcggaagtgccgataccaaaggccagtgcgccaaacgcgccgtgggtggcggtatgcgagtcgccgcagacaatggtcatccccggcaaggtgacgccctgttccggccccattacgtggacgatcccctgatacgggtgattcaggtcatacagttcgacgccaaattctttgcagtttttgatcagttcctgcatctggatacgcgccatttcaccgcaggcattaatgtctttggtctgggtagagacgttgtgatccatggtagcgaaggttttgcccggctgacgtaccgggcgaccgtgggcgcgcagaccatcgaacgcctgcggtgaggtcacttcatgcaccaggtggcggtcgatatataacagtggggtttcgttttcggcttcgtacacaacgtgagcgtcgaacaatttttcgtataacgttttagccatgattacaccccttctgccacatagcgggcaatgatatcgcccatttcatcggtactaacggcggcagcgccacgggctaaatccccggtgcgaatgccttcttctaatgcgcggttaatggcgcgttcaatggcgcaagccgcatcatcggcatccaggctgtagcgcagcagcagtgccagcgacagaatttgcgcaatcgggttggcgatgtttttgcctgcgatatctggtgctgagccgcctgccggttcatacagaccaaaaccttgctcgttcaggctggcggaaggcaacatccccatcgagccagtgatcattgcgcactcgtcagacagaatgtcgccaaacaggttggagcacagcagaacgtcaaactgtgatggatctttaatcagctgcatggtggcgttgtcgatgtacatatgcgccagttcgacatccgggtattccgtggcgatctcgttaacgatctcccgccataaaatagaggattgcagcacgttggctttatcgatcgacgtcactttgtggcgacgcttgcgagcagattcaaacgcgatgcgggcgatacgttcgatctcaaaacggtgatacacctcggtatcaaaggctttttcatattgtccgctaccttcgcggccttttggctgaccgaaatagatgccgccggtcagttcgcgcacacacaggatgtcgaagccgtttgcggcaatgtctgcacgcagcggacagaatgcttccagcccctgatacagttttgccgggcgcaggttgctgaataatttgaagtgcttacgcagaggcagcagcgcgccgcgttctggttgctggtctggtggtaaatgttcccatttcggaccgcctaccgagccaaacagcacggcatcggcttgctcacaaccttcaaccgtcgcaggcggcagcggctgcccgtggttatcaatggctgcgccgcctacatcgtaatggctggtggtgatgcgcatcgcaaagcggttgcgcacggcatccagcactttcagcgcctgggtcatcacttccggaccaataccgtcccccggcaatacggcaatatggtaattcttcgacatcacacggtttccttgttgttttcgttgtgttgagctttgcgttgcaactctttttcgacttctgcggcgcgccagatattgttcagtacgtgcaccatggctttggcggaggactcgacaatatcggtggccaggccgacgccgtggaagcggcgaccgttgtagttagcgacaatatccacctgacccagagcatctttaccgtgacctttagcagtcaggctgtatttcaccagttcgacgttatagtcagtgatgcggttaattgcctgatagacggcatcgaccggaccgttaccgttggcggcttctgctttgacttcttcgccacaggccagtttgacggcggcggtggcgatatcgttagagccagactgcacgctgaagtaatccagacggaaatgctccggctcttcttgctgcttaccgatgaaggccagcgcctccagatcgtaatcaaacacctgaccttttttgtccgccagcttcaggaaagcatcgtacaaattgtctaaattatattcactttctttataccccatctcatccatgcgatgtttcaccgccgcacgccccgaacgagaggtcagattcagctggatttggttcagaccaatagattctggtgtcatgatttcgtagttttcgcggtttttcagcacgccatcctggtggataccggaggagtgagcgaatgcgccgctgccaacaatggctttgtttgccgggatcggcatattacaaatctggctaactaactggctggtgcgccatatctcctggtgattaatggcggtgtggacgttgagaatatccttacgaactttaatcgccatgatgacttcttccagcgaacagttaccggcacgctcgccgatcccgttcattgcaccttccacctggcgtgcaccggcatgtaccgccgccagtgagttgccgaccgccaggcctaaatcgtcgtgggtatgtacggaaataatggctttgtcgatgttaggtacgcgttcatacaggccgctgatgattccggcgaactcaaacggcatggtgtagcccacggtgtccggaatgttgatggtggtggcaccggcattaatcgccgcttcgaccactcgcgccagatcggcaatgggtgtacgcccggcatcttcgcaagaaaattcaacatcatcggtgtaattacgggcgcgtttcaccatatagatagcgcgttcgatcacttcatccagcgtgctgcgcagcttggtggcgatgtgcattggcgaagtggcaataaaggtatgaatacggaaggcttcggcgactttcagggattcggccgccacgtcgatatctttctccacgcagcgagctaacgcacatacgcggctgtttttaacctggcgggcgatggtttgcaccgattcaaaatcgcccggcgaagagacggggaaaccgacttccatcacgtcaacacccatacgctcaagggccagcgcaatttgcagtttttctttcacactcaagcttgcctgtaacgcctgttcaccgtcgcgcaatgtggtatcgaaaataatgacttgctggctcatggtttgggtccttgtctcttttagagcgcctcgcttcgggcataaaaaaacccgcgcaatggcgcgggttttttgtttgactgcgtgctggcttaatgctggatgccgctcactcgtctaccgcgcaaagaagatgcgtttagtagtagtagaccgataaagcgaacgatgtgagtcattaaatcagctccagatgaatgcgatatgcttttagagttactggatacaaaaacggatgtcaaccctgacgcaataaaaacgtcccgccagcgtgagttctgcatccgtaaaattagctaattgtgctgcggtggttaaagtaagcgatattaatttctgcttaactaccgacgcttttcatcggttgacatatttcagcataaatttttgcatctaatcaacgaggaaaaaggggacaaaatgcacgcgttgcaaaacctatcctgatgatttgtattgaattatatgttttgcgattttttttgatattgatttggtgaatattattgatcaattaatgttaagaattaatgcattaaatatataaattaattattaaataagcacatttaatccattttgtagatgattgagtattcgcggtagttatgattagattgttttcgcaacaaaaacattatggattattatgctgtggtaaatgactcattccacggcaatggattctgtttttatcagaacccgtatctttatgttttccgaattttactcattttgctttttcttattttatatgcatgataaatcatattcttcaggattatttctctgcattccaataagggaaagggagttaagtgtgacagtggagttaagtatgccagaggtacaaacagatcattcagagacggcggagttaagcaagccacagctacgcatggtcgatctcaacttattaaccgttttcgatgccgtgatgcaggagcaaaacattacccgtgccgctcatgttctgggtatgtcgcaacctgcggtcagtaacgctgttgcacgcctgaaggtgatgtttaatgacgagctttttgttcgttatggccgtggtattcaaccgactgctcgcgcatttcaactttttggctcagttcgtcaggcattgcaactagtacaaaatgaattgcctggttcaggttttgaacccgcgagcagtgaacgtgtatttcatctttgtgtttgcagcccgttagacagcattctgacctcgcagatttataatcacattgagcagattgcgccaaatatacatgttatgttcaagtcttcattaaatcagaacactgaacatcagctacgttatcaggaaacggagtttgtgattagttatgaagacttccatcgtcctgaatttaccagcgtgccattatttaaagatgaaatggtgctggtagccagcaaaaatcatccaacaattaagggcccgttactgaaacatgatgtttataacgaacaacatgcggcggtttcgctcgatcgtttcgcgtcatttagtcaaccttggtatgacacggtagataagcaagccagtatcgcgtatcagggcatggcaatgatgagcgtacttagcgtggtgtcgcaaacgcatttggtcgctattgcgccgcgttggctggctgaagagttcgctgaatccttagaattacaggtattaccgctgccgttaaaacaaaatagcagaacctgttatctctcctggcatgaagctgccgggcgcgataaaggccatcagtggatggaagagcaattagtctcaatttgcaaacgctaactgaatgcagaataggtcaggcatgaatgtctggtttattctgtattttttattgaatgtagaattttattctgaatgtgtgggctctctgttttaggattaattaaaaaaatagagaaattgctgtaagttgtgggattcagccgatttattatcaatttaatccttcgtaatggaggattttatcgtttcttttcacctttcctcctgtttattcttattaccctgcgtttatgtctctggctgccaattgcttaagcaagatcggacggttaatgtgttttacacattttttccgtcaaacagtgaggcaggccatggagatgttgtctggagccgagatggtcgtccgatcgcttatcgatcagggcgttaaacaagtattcggttatcccggaggcgcagtccttgatatttacgatgcattgcataccgtgggtggtatcgatcatgttttagttcgtcatgagcaggcggcagtgcatatggccgatggtctggcgcgcgcgaccggggaagtcggcgtcgtgctggtaacgtcgggtccaggggcgaccaatgcgattaccggcatcgccaccgcttatatggattccattccattagttgtcctttccgggcaggtagcgacctcgttgataggttacgatgcctttcaggagtgcgacatggtggggatttcgcgaccggtggttaaacacagttttctggttaagcaaacggaagacattccgcaggtgctgaaaaaggctttctggctggcggcaagtggtcgcccaggaccagtggtcgttgatttaccgaaagatattcttaatccggcgaacaaattaccctatgtctggcctgagtcggtcagtatgcgttcttacaatcccactactaccggacataaagggcaaattaagcgcgctctgcaaacgctggtagcggcaaaaaaaccggttgtctacgtaggcggtggggcaatcatggcgggctgccatcagcagttgaaagaaacggtggaggcgttgaatctgcccgttgtttcctcattgatggggctgggggcgtttccggcaacgcatcgtcaggcgctgggcatgctgggaatgcacggtacctacgaagccaatatgacgatgcataacgcggatgtgattttcgccgtcggggtacgatttgatgaccgaacgacgaacaatctggcaaagtactgcccaaatgccactgttctgcatatcgatattgatcctacttccatttctaaaaccgtgactgcggatatcccgattgtgggggatgctcgccaggtcctcgaacaaatgcttgaactcttgtcgcaagaatccgcccatcaaccactggatgagatccgcgactggtggcagcaaattgaacagtggcgcgctcgtcagtgcctgaaatatgacactcacagtgaaaagattaaaccgcaggcggtgatcgagactctttggcggttgacgaagggagacgcttacgtgacgtccgatgtcgggcagcaccagatgtttgctgcactttattatccattcgacaaaccgcgtcgctggatcaattccggtggcctcggcacgatgggttttggtttacctgcggcactgggcgtcaaaatggcgttgccagaagaaaccgtggtttgcgtcactggcgacggcagtattcagatgaacatccaggaactgtctaccgcgttgcaatacgagttgccggtactggtggtgaatctcaataaccgctatctggggatggtgaaacagtggcaggacatgatctattccggccgtcattcacaatcttatatgcaatcactacccgatttcgtccgtctggcggaagcctatggtcacgtcgggatccagatctctcatccgcatgagctggaaagcaaacttagcgaggcgctggaacaggtgtgcaataatcgcctggtgtttgttgatgttaccgtcgatggcagtgagcacgtctacccgatgcagattcgcgggggcggaatggatgaaatgtggttaagcaaaacggagagaacctgattatgcgccggatattatcagtcttactcgaaaatgaatcaggcgcgttatcccgcgtgattggccttttttcccagcgtggctacaacattgaaagcctgaccgttgcgccaaccgacgatccgacattatcgcgtatgaccatccagaccgtgggcgatgaaaaagtgcttgagcagatcgaaaagcaattacacaagctggtcgatgtcttgcgcgtgagtgagttggggcagggcgcgcatgttgagcgggaaatcatgctggtgaaaattcaggccagcggttacgggcgtgacgaagtgaaacgtaatacggaaatattccgtgggcaaattatcgatgtcaccccctcgctttataccgttcaattagcaggcaccagcgataagcttgatgcatttttagcatcgattcgcgatgtggcgaaaattgtggaagttgctcgctctggtgtggtcggactttcgcgcggcgataaaataatgcgttgagaatgatctcagtgcgcaatttgcagcccaacatgtcacgttgggctttttttgcgaaatcagtgggaacctggaataaaagcagttgccgcagttaattttctgcgcttagatgttaatgaatttaacccataccagtacaatggctatggtttttacattttacgcaaggggcaattgtgaaactggatgaaatcgctcggctggcgggagtgtcgcggaccactgcaagctatgttattaacggcaaagcgaagcaataccgtgtgagcgacaaaaccgttgaaaaagtcatggctgtggtgcgtgagcacaattaccacccgaacgccgtggcagctgggcttcgtgctggacgcacacgttctattggtcttgtgatccccgatctggagaacaccagctatacccgcatcgctaactatcttgagcgccaggcgcggcaacggggttatcaactgctgattgcctgctcagaagatcagccagacaacgaaatgcgctgcattgagcaccttttacagcgtcaggttgatgccattattgtttcgacgtcgttgccacctgagcatcctttttatcaacgctgggctaacgacccgttcccgattgtcgcgctggaccgcgccctcgatcgtgaacatttcaccagcgtggttggtgccgatcaggatgatgccgaaatgctggcggaagagttacgtaagtttcccgccgagacggtgctttatcttggcgcgctgccggagctttctgtcagcttcctgcgtgaacaaggtttccgtactgcctggaaagatgatccgcgcgaagtgcatttcctgtatgccaacagctatgagcgggaggcggctgcccagttattcgaaaaatggctggaaacgcatccgatgccgcaggcgctgttcacaacgtcgtttgcgttgttgcaaggggtgatggatgtcacgctacgtcgcgatggtaaactgccttctgacctggcaattgccacctttggcgataacgaactgctcgacttcttacagtgcccggtgctggcagtggctcaacgtcaccgcgatgtcgcagagcgtgtgctggagattgtcctggcaagcctggacgaaccgcgtaagccaaaacctggtttaacgcgcattaaacgtaatctctatcgccgcggtgtgctcagccgtagctaagccgcgaacaaaaatacgcgccaggtgaatttccctctggcgcgtagagtacgggaatggacatcaatatccttaaagtaaataagactattcctgactattattgataagttcttttaaacccgcccgttaattaactcaccagctgaaattcacaataattaagtgatatcgacagcgcgtttttgcattattttgttacatgcagagatgaattgccgatttaacaagcacttttctttgcttttgcgcaaacccgctggcatcaagcgccacacagacgcaacagggactgttaaccggggaagatatgtcctaaaatgccgctcgcgtcgcaaactgacactttatatttgctgtggaaaatagtgagtcattttaaaacggtgatgacgatgagggattttttcttacagctattcataacgttaatttgctgcgcacgttggacgtaaaataaacaacgctgatattagccgtaaacatcgggttttttacctcggtatgccttgtgactggcttgacaagcttttcctccgctccgtaaactcctttcagtgggaaattgtggggcaaagtgggaataaggggtgaggctggcatgttccggggagcaacgttagtcaatctcgacagcaaagggcgcttatcagtgcctacccgttaccgggaacagctgcttgagaacgctgccggtcaaatggtttgcaccattgacattcatcacccgtgcctgctgctttaccccctgcctgaatgggaaattatcgagcaaaaattatcgcgtctgtcgagcatgaacccggttgagcgccgtgtgcagcgcctactgttaggtcatgccagcgaatgtcagatggatggcgcaggtcgattgttaatcgcgccagtactgcggcaacatgccgggctgacaaaagaagtgatgctggttggacagttcaacaagtttgagctgtgggatgaaacaacctggcatcaacaggtcaaggaagatatcgacgcagagcagttggctaccggagacttatcggagcgactgcaggacttgtctctataaaatgatggaaaactataaacatactacggtgctgctggatgaagccgttaatggcctcaatatccgtcctgatggcatctacattgatgggacttttggtcgcggtggtcactcacgtctgatcctctcgcagcttggcgaagaggggcgtttgctggcgatcgatcgcgacccgcaggctatcgccgttgcgaagactattgatgatccgcgcttctccatcatccacggacctttctccgcgctgggcgaatacgttgccgagcgcgatcttatcggcaagatcgacggcattctcctcgatcttggcgtctcttcaccgcaacttgatgatgctgagcgcggcttttcctttatgcgcgatggtccgctggacatgcgtatggacccaacccgtgggcagtcagccgctgaatggctgcaaaccgcagaagaagccgatatcgcctgggtattgaaaacctatggtgaagagcgttttgccaaacgcattgcccgcgccattgtcgagcgtaaccgcgaacagccgatgacccgcaccaaagaactggcggaagtcgtggctgccgcaacgccggtgaaagacaaattcaaacatcccgcgacccgtaccttccaggcggtgcgcatttgggtaaacagtgaactggaggagatagagcaggcgctaaaaagctcgctcaacgtgctggccccgggtgggcggctttcgatcatcagcttccactcgctggaagaccgtattgtgaaacgttttatgcgtgaaaacagccgcggtccgcaagttccggcagggttaccgatgactgaagagcagctcaaaaaactgggtggccgtcagctgcgagcattaggcaagttaatgccgggcgaagaagaggtggctgagaatcctcgtgcccgtagttcagttctgcgtattgcagagaggacgaacgcatgatcagcagagtgacagaagctctaagcaaagttaaaggatcgatgggaagccacgagcgccatgcattgcctggtgttatcggtgacgatcttttgcgatttgggaagctgccactctgcctgttcatttgcattattttgacggcggtgaccgtggtaaccacggcgcaccatacccgtttactgaccgctcagcgcgaacaactggtgctggagcgagatgctttagacattgaatggcgcaacctgatccttgaagagaatgcgctcggcgaccatagccgggtggaaaggatcgccacggaaaaactgcaaatgcagcatgttgatccgtcacaagaaaatatcgtagtgcaaaaataaggataaacgcgacgcatgaaagcagcggcgaaaacgcagaaaccaaaacgtcaggaagaacatgccaactttatcagttggcgttttgcgttgttatgcggctgtattctcctggcgctggcttttctgctcggacgcgtagcgtggttacaagttatctccccggatatgctggtgaaagagggcgacatgcgttctcttcgcgttcagcaagtttccacctcccgcggcatgattactgaccgttctggtcgcccgttagcggtgagcgtgccggtaaaagcgatttgggctgacccgaaagaagtgcatgacgctggcggtatcagcgtcggtgaccgctggaaggcgctggctaacgcgctcaatattccgctggatcagctttcagcccgcattaacgccaacccgaaagggcgctttatttatctggcgcgtcaggtgaaccctgacatggcggactacatcaaaaaactgaaactgccggggattcatctgcgtgaagagtctcgccgttactatccgtccggcgaagtgactgctcacctcatcggctttactaacgtcgatagtcaagggattgagggcgttgagaagagtttcgataaatggcttaccgggcagccgggtgagcgcattgtgcgtaaagaccgctatggtcgcgtaattgaagatatttcttctactgacagccaggcagcgcacaacttggcgctgagtattgatgaacgcctgcaggcgctggtttatcgcgaactgaacaacgcggtggcctttaacaaggctgagtccggtagcgccgtgctggtggatgtcaacaccggtgaagtgctggcgatggctaacagcccgtcatacaacccaaataatctgagcggcacgccgaaagaggcgatgcgtaaccgtaccatcaccgacgtgtttgaaccgggctcaacggttaaaccgatggtggtgatgaccgcgttgcaacgtggcgtggtgcgggaaaactcggtactcaataccgttccttatcgaattaacggccacgaaatcaaagacgtggcacgctacagcgaattaaccctgaccggggtattacagaagtcgagtaacgtcggtgtttccaagctggcgttagcgatgccgtcctcagcgttagtagatacttactcacgttttggactgggaaaagcgaccaatttggggttggtcggagaacgcagtggcttatatcctcaaaaacaacggtggtctgacatagagagggccaccttctctttcggctacgggctaatggtaacaccgttacagttagcgcgagtctacgcaactatcggcagctacggcatttatcgcccactgtcgattaccaaagttgaccccccggttcccggtgaacgtgtcttcccggaatccattgtccgcactgtggtgcatatgatggaaagcgtggcgctaccgggcggcggcggcgtgaaggcggcgattaaaggctatcgtatcgccattaaaaccggtaccgcgaaaaaggtcgggccggacggtcgctacatcaataaatatattgcttataccgcaggcgttgcgcctgcgagtcagccgcgcttcgcgctggttgttgttatcaacgatccgcaggcgggtaaatactacggcggcgccgtttccgcgccggtctttggtgccatcatgggcggcgtattgcgtaccatgaacatcgagccggatgcgctgacaacgggcgataaaaatgaatttgtgattaatcaaggcgaggggacaggtggcagatcgtaatttgcgcgaccttcttgctccgtgggtgccagacgcaccttcgcgagcactgcgagagatgacactcgacagccgtgtggctgcggcgggcgatctctttgtagctgtagtaggtcatcaggcggacgggcgtcgatatatcccgcaggcgatagcgcaaggtgtggctgccattattgcagaggcgaaagatgaggcgaccgacggtgaaatccgtgaaatgcacggcgtaccggtcatctatctcagccagctcaatgagcgtttatctgcactggcgggccgcttttaccatgaaccctctgacaatttacgtctcgtaggcgtaacgggcaccaacggcaaaaccacgacgacccagctgctggcgcagtggagccaactgcttggcgaaaccagcgcggtaatgggcaccgttggtaacggtctgctggggaaagtgatcccgacagaaaatactaccggttcggcagtcgatgttcagcatgagctggcggggctggtggatcagggcgcgactttttgcgcaatggaagtttcctcccacgggctggtacagcaccgtgtggcggcattgaaatttgcggcgtcggtctttaccaacttaagccgcgatcaccttgattatcatggtgatatggaacactacgaagctgcgaaatggctgctttattctgaacatcattgcggtcaggcgattattaacgccgacgatgaagtgggccgccgctggctggcaaaactgccggacgcggttgcggtatcaatggaagatcatatcaatccgaactgtcacggacgctggttgaaagcgaccgaagtgaactatcacgacagcggtgcgacgattcgctttagctcaagttggggcgatggcgaaattgaaagccatctgatgggcgcttttaacgtcagcaacctgctgctcgcgctggcgacactgttggcactcggctatccactggctgatctgctgaaaaccgccgcgcgtctgcaaccggtttgcggacgtatggaagtgttcactgcgccaggcaaaccgacggtggtggtggattacgcgcatacgccggatgcactggaaaaagccttacaggcggcgcgtctgcactgtgcgggcaagctgtggtgtgtctttggctgtggtggcgatcgcgataaaggtaagcgtccactgatgggcgcaattgccgaagagtttgctgacgtggcggtggtgacggacgataacccgcgtaccgaagaaccgcgtgccatcatcaacgatattctggcgggaatgttagatgccggacatgccaaagtgatggaaggccgtgctgaagcggtgacttgcgccgttatgcaggctaaagagaatgatgtggtactggtcgcgggcaaaggccatgaagattaccagattgttggcaatcagcgtctggactactccgatcgcgtcacggtggcgcgtctgctgggggtgattgcatgattagcgtaacccttagccaacttaccgacattctcaacggtgaactgcaaggtgcagatatcacccttgatgctgtaaccactgatacccgaaaactgacgccgggctgcctgtttgttgccctgaaaggcgaacgttttgatgcccacgattttgccgaccaggcgaaagctggcggcgcaggcgcactactggttagccgtccgctggacatcgacctgccgcagttaatcgtcaaggatacgcgtctggcgtttggtgaactggctgcatgggttcgccagcaagttccggcgcgcgtggttgctctgacggggtcctccggcaaaacctccgttaaagagatgacggcggcgattttaagccagtgcggcaacacgctttatacggcaggcaatctcaacaacgacatcggtgtaccgatgacgctgttgcgcttaacgccggaatacgattacgcagttattgaacttggcgcgaaccatcagggcgaaatagcctggactgtgagtctgactcgcccggaagctgcgctggtcaacaacctggcagcggcgcatctggaaggttttggctcgcttgcgggtgtcgcgaaagcgaaaggtgaaatctttagcggcctgccggaaaacggtatcgccattatgaacgccgacaacaacgactggctgaactggcagagcgtaattggctcacgcaaagtgtggcgtttctcacccaatgccgccaacagcgatttcaccgccaccaatatccatgtgacctcgcacggtacggaatttaccctacaaaccccaaccggtagcgtcgatgttctgctgccgttgccggggcgtcacaatattgcgaatgcgctggcagccgctgcgctctccatgtccgtgggcgcaacgcttgatgctatcaaagcggggctggcaaatctgaaagctgttccaggccgtctgttccccatccaactggcagaaaaccagttgctgctcgacgactcctacaacgccaatgtcggttcaatgaccgccgctgttcaggtactggctgaaatgccgggctaccgcgtgctggtggtgggcgatatggcggaactgggcgctgaaagcgaagcctgccatgtacaggtgggcgaggcggcaaaagctgctggtattgaccgcgtgttaagcgtgggtaaacaaagccatgctatcagcaccgccagcggcgttggcgaacattttgctgataaaactgcgttaattacgcgtcttaaatcactgattgctgagcaacaggtaattacgattttagttaagggttcacgtagtgccgccatggaagaggtagtacgcgctttacaggagaatgggacatgttagtttggctggccgaacatttggtcaaatattattccggctttaacgtcttttcctatctgacgtttcgcgccatcgtcagcctgctgaccgcgctgttcatctcattgtggatgggcccgcgtatgattgctcatttgcaaaaactttcctttggtcaggtggtgcgtaacgacggtcctgaatcacacttcagcaagcgcggtacgccgaccatgggcgggattatgatcctgacggcgattgtgatctccgtactgctgtgggcttacccgtccaatccgtacgtctggtgcgtgttggtggtgctggtaggttacggtgttattggctttgttgatgattatcgcaaagtggtgcgtaaagacaccaaagggttgatcgctcgttggaagtatttctggatgtcggtcattgcgctgggtgtcgccttcgccctgtaccttgccggcaaagacacgcccgcaacgcagctggtggtcccattctttaaagatgtgatgccgcagctggggctgttctacattctgctggcttacttcgtcattgtgggtactggcaacgcggtaaacctgaccgatggtctcgacggcctggcaattatgccgaccgtatttgtcgccggtggttttgcgctggtggcgtgggcgaccggcaatatgaactttgccagctacttgcatataccgtatctgcgacacgccggggaactggttattgtctgtaccgcgatagtcggggcaggactgggcttcctgtggtttaacacctatccggcgcaggtctttatgggcgatgtaggttcgctggcgttaggtggtgcgttaggcattatcgccgtactgctacgtcaggaattcctgctggtgattatggggggcgtgttcgtggtagaaacgctttctgtcatcctgcaggtcggctcctttaaactgcgcggacaacgtattttccgcatggcaccgattcatcaccactatgaactgaaaggctggccggaaccgcgcgtcattgtgcgtttctggattatttcgctgatgctggttctgattggtctggcaacgctgaaggtacgttaatcatggctgattatcagggtaaaaatgtcgtcattatcggcctgggcctcaccgggctttcctgcgtggactttttcctcgctcgcggtgtgacgccgcgcgttatggatacgcgtatgacaccgcctggcctggataaattacccgaagccgtagaacgccacacgggcagtctgaatgatgaatggctgatggcggcagatctgattgtcgccagtcccggtattgcactggcgcatccatccttaagcgctgccgctgatgccggaatcgaaatcgttggcgatatcgagctgttctgtcgcgaagcacaagcaccgattgtggcgattaccggttctaacggcaaaagcacggtcaccacgctagtgggtgaaatggcgaaagcggcgggggttaacgttggtgtgggtggcaatattggcctgcctgcgttgatgctactggatgatgagtgtgaactgtacgtgctggaactgtcgagcttccagctggaaaccacctccagcttacaggcggtagcagcgaccattctgaacgtgactgaagatcatatggatcgctatccgtttggtttacaacagtatcgtgcagcaaaactgcgcatttacgaaaacgcgaaagtttgcgtggttaatgctgatgatgccttaacaatgccgattcgcggtgcggatgaacgctgcgtcagctttggcgtcaacatgggtgactatcacctgaatcatcagcagggcgaaacctggctgcgggttaaaggcgagaaagtgctgaatgtgaaagagatgaaactttccgggcagcataactacaccaatgcgctggcggcgctggcgctggcagatgctgcagggttaccgcgtgccagcagcctgaaagcgttaaccacattcactggtctgccgcatcgctttgaagttgtgctggagcataacggcgtacgttggattaacgattcgaaagcgaccaacgtcggcagtacggaagcggcgctgaatggcctgcacgtagacggcacactgcatttgttgctgggtggcgatggtaaatcggcggactttagcccactggcgcgttacctgaatggcgataacgtacgtctgtattgtttcggtcgtgacggcgcgcagctggcggcgctacgcccggaagtggcagaacaaaccgaaactatggaacaggcgatgcgcttgctggctccgcgtgttcagccgggcgatatggttctgctctccccagcctgtgccagccttgatcagttcaagaactttgaacaacgaggcaatgagtttgcccgtctggcgaaggagttaggttgatgcgtttatctctccctcgcctgaaaatgccgcgcctgccaggattcagtatcctggtctggatctccacggcgctaaagggctgggtgatgggctcgcgggaaaaagataccgacagcctgatcatgtacgatcgcaccttactgtggctgaccttcggcctcgcggcgattggctttatcatggtgacctcggcgtcaatgcccatagggcaacgcttaaccaacgatccgttcttcttcgcgaagcgtgatggtgtctatctgattttggcgtttattctggcgatcattacgctgcgtctgccgatggagttctggcaacgctacagtgccacgatgctgctcggatctatcatcctgctgatgatcgtcctggtagtgggtagctcggttaaaggggcatcgcgttggatcgatctcggtttgctgcgtatccagcctgcggagctgacaaaactgtcgctgttttgctatatcgccaactatctggtgcgtaaaggcgacgaagtacgtaataacctgcgcggcttcctgaaaccgatgggcgtgattctggtgttggcagtgttactgctggcacagccagaccttggtacggtggtggtgttgtttgtgactacgctggcgatgttgttcctggcgggagcgaaattgtggcagttcattgccattatcggtatgggcatttcagcggttgtgttgctgatactcgccgaaccgtaccgtatccgccgtgttaccgcattctggaacccgtgggaagatccctttggcagcggctatcagttaacgcaatcgctgatggcgtttggtcgcggcgaactttgggggcaaggtttaggtaactcggtacaaaaactggagtatctgccggaagcgcacactgactttattttcgccattatcggcgaagaactggggtatgtcggtgtggtgctggcacttttaatggtattcttcgtcgcttttcgcgcgatgtcgattggccgtaaagcattagaaattgaccaccgtttttccggttttctcgcctgttctattggcatctggtttagcttccaggcgctggttaacgtaggcgcggcggcggggatgttaccgaccaaaggtctgacattgccgctgatcagttacggtggttcgagcttactgattatgtcgacagccatcatgatgctgttgcgtattgattatgaaacgcgtctggagaaagcgcaggcgtttgtacgaggttcacgatgagtggtcaaggaaagcgattaatggtgatggcaggcggaaccggtggacatgtattcccgggactggcggttgcgcaccatctaatggctcagggttggcaagttcgctggctggggactgccgaccgtatggaagcggacttagtgccaaaacatggcatcgaaattgatttcattcgtatctctggtctgcgtggaaaaggtataaaagcactgatagctgccccgctgcgtatcttcaacgcctggcgtcaggcgcgggcgattatgaaagcgtacaaacctgacgtggtgctcggtatgggaggctacgtgtcaggtccaggtggtctggccgcgtggtcgttaggcattccggttgtacttcatgaacaaaacggtattgcgggcttaaccaataaatggctggcgaagattgccaccaaagtgatgcaggcgtttccaggtgctttccctaatgcggaagtagtgggtaacccggtgcgtaccgatgtgttggcgctgtcgttgccgcagcaacgtttggctggacgtgaaggtccggttcgtgtgctggtagtgggtggttctcagggcgcacgcattcttaaccagacaatgccgcaggttgctgcgaaactgggtgattcagtcactatctggcatcagagcggcaaaggttcgcaacaatccgttgaacaggcgtatgccgaagcggggcaaccgcagcataaagtgacggaatttattgatgatatggcggcggcgtatgcgtgggcggatgtcgtcgtttgccgctccggtgcgttaacggtgagtgaaatcgccgcggcaggactaccggcgttgtttgtgccgtttcaacataaagaccgccagcaatactggaatgcgctaccgctggaaaaagcgggcgcagccaaaattatcgagcagccacagcttagcgtggatgctgtcgccaacaccctggccgggtggtcgcgagaaaccttattaaccatggcagaacgcgcccgcgctgcatccattccggatgccaccgagcgagtggcaaatgaagtgagccgggttgcccgggcgtaattgtagcgatgccttttgcatcgtatgaatttaagaagttaatggcgtaaagaatgaatacacaacaattggcaaaactgcgttccatcgtgcccgaaatgcgtcgcgttcggcacatacattttgtcggcattggtggtgccggtatgggcggtattgccgaagttctggccaatgaaggttatcagatcagtggttccgatttagcgccaaatccggtcacgcagcagttaatgaatctgggtgcgacgatttatttcaaccatcgcccggaaaacgtacgtgatgccagcgtggtcgttgtttccagcgccatttctgccgataacccggaaattgtcgcagctcatgaagcgcgtattccggtgatccgtcgtgccgaaatgctggctgagttaatgcgttttcgtcatggcatcgccattgcaggaacgcacggcaaaacgacaaccaccgcgatggtttccagcatctacgcagaagcggggctcgacccaaccttcgttaacggcgggctggtaaaagcggcgggggttcatgcgcgtttggggcatggtcggtacctgattgccgaagcagatgagagtgatgcatcgttcctgcatctgcaaccgatggtggcgattgtcaccaatatcgaagccgaccacatggatacctaccagggcgactttgagaatttaaaacagacttttattaattttctgcacaacctgccgttttacggtcgtgcggtgatgtgtgttgatgatccggtgatccgcgaattgttaccgcgagtgggacgtcagaccacgacttacggcttcagcgaagatgccgacgtgcgtgtagaagattatcagcagattggcccgcaggggcactttacgctgctgcgccaggacaaagagccgatgcgcgtcaccctgaatgcgccaggtcgtcataacgcgctgaacgccgcagctgcggttgcggttgctacggaagagggaattgatgacgaggctattttacgtgcgctggagagcttccaggggactgggcgccgttttgatttcctcggtgaattcccgctggagccagtgaatggtaaaagcggtacggcaatgctggtcgatgactacggccaccacccgacggaagttgacgccaccattaaagcggcgcgcgcaggctggccggataaaaacctggtaatgctgtttcagccgcaccgttttacccgtacgcgcgacctgtatgatgatttcgccaatgtgctgacgcaggttgataccctgttgatgctggaagtgtatccggctggcgaagcgccaattccgggagcggacagccgttcgctgtgtcgcacaattcgtggacgtgggaaaattgatcccattctggtgccggaccctgcgcaggtagccgagatgctggcaccggtattaaccggtaacgacctgattctcgttcagggggctggtaatatcggaaaaattgcccgttctttagctgaaatcaaactgaagccgcaaactccggaggaagaacaacatgactgataaaatcgcggtcctgttgggcgggacttccgctgagcgggaagtttctctgaattctggcgcagcggtgttagccgggctgcgtgaaggcggtattgatgcgtatcctgtcgacccgaaagaagtcgacgtgacgcaactgaagtcgatgggttttcagaaagtgtttatcgcgctacacggtcgcggcggtgaagatggtacgctgcagggcatgctcgagctgatgggcttgccttataccggcagcggagtgatggcatctgcgctttcaatggataaactacgcagcaaactgctgtggcaaggtgccggtttaccggtcgcgccgtgggtagcgttaacccgcgcagagtttgaaaaaggcctgagcgataagcagttagcagaaatttctgctctgggtttgccggttatcgttaagccgagccgcgaaggttccagtgtgggaatgtcaaaagtagtagcagaaaatgctctacaagatgcattaagattggcatttcagcacgatgaagaagtattgattgaaaaatggctaagtgggccggagttcacggttgcgatactcggtgaagaaattttaccgtcaatacgtattcaaccgtccggaaccttctatgattatgaggcgaagtatctctctgatgagacacagtatttctgccccgcaggtctggaagcgtcacaagaggccaatttgcaggcattagtgctgaaagcatggacgacgttaggttgcaaaggatggggacgtattgacgttatgctggacagcgatggacagttttatctgctggaagccaatacctcaccgggtatgaccagccacagcctggtgccgatggcggcacgtcaggcaggtatgagcttctcgcagttggtagtacgaattctggaactggcggactaatatgtcgcaggctgctctgaacacgcgaaatagcgaagaagaggtttcttctcgccgcaataatggaacgcgtctggcggggatccttttcctgctgaccgttttaacgacagtgttggtgagcggctgggtcgtgttgggctggatggaagatgcgcaacgcctgccgctctcaaagctggtgttgaccggtgaacgccattacacgcgtaatgacgatatccggcagtcgatcctggcattgggtgagccgggtacctttatgacccaggatgtcaacatcatccagacgcaaatagaacaacgcctgccgtggattaagcaggtgagcgtcagaaagcagtggcctgatgaattgaagattcatctggttgaatatgtgccgattgcgcggtggaatgatcaacacatggtagacgcggaaggaaacaccttcagcgtgccgccagatcgcaccagcaagcaggtgcttccaatgctgtatggcccggaaggcagcgccaatgaagtgttgcagggctatcgcgaaatggggcagatgctggcaaaggacagatttactctgaaggaagcggcgatgaccgcgcggcgttcctggcagttgacgctgaataacgatattaagctcaatcttggccggggcgatacgatgaaacgtttggctcgctttgtagaactttatccggttttacagcagcaggcgcaaaccgatggcaaacggattagctacgttgatttgcgttatgactctggagcggcagtaggctgggcgcccttgccgccagaggaatctactcagcaacaaaatcaggcacaggcagaacaacaatgatcaaggcgacggacagaaaactggtagtaggactggagattggtaccgcgaaggttgccgctttagtaggggaagttctgcccgacggtatggtcaatatcattggcgtgggcagctgcccgtcacgtggtatggataaaggcggggtgaacgacctcgaatccgtggtcaagtgcgtacaacgcgccattgaccaggcagaattgatggcagattgtcagatctcttcggtatatctggcgctttctggtaagcacatcagctgccagaatgaaattggtatggtgcctatttctgaagaagaagtgacgcaagaagatgtggaaaacgtcgtccataccgcgaaatcggtgcgtgtgcgcgatgagcatcgtgtgctgcatgtgatcccgcaagagtatgcgattgactatcaggaagggatcaagaatccggtaggactttcgggcgtgcggatgcaggcaaaagtgcacctgatcacatgtcacaacgatatggcgaaaaacatcgtcaaagcggttgaacgttgtgggctgaaagttgaccaactgatatttgccggactggcatcaagttattcggtattgacggaagatgaacgtgaactgggtgtctgcgtcgtcgatatcggtggtggtacaatggatatcgccgtttataccggtggggcattgcgccacactaaggtaattccttatgctggcaatgtcgtgaccagtgatatcgcttacgcctttggcacgccgccaagcgacgccgaagcgattaaagttcgccacggttgtgcgctgggttccatcgttggaaaagatgagagcgtggaagtgccgagcgtaggtggtcgtccgccgcggagtctgcaacgtcagaccctggcagaggtgatcgagccgcgctataccgagctgctcaacctggtcaacgaagagatattgcagttgcaggaaaagcttcgccaacaaggggttaaacatcacctggcggcaggcattgtattaaccggtggcgcagcgcagatcgaaggtcttgcagcctgtgctcagcgcgtgtttcatacgcaagtgcgtatcggcgcgccgctgaacattaccggtttaacggattatgctcaggagccgtattattcgacggcggtgggattgcttcactatgggaaagagtcacatcttaacggtgaagctgaagtagaaaaacgtgttacagcatcagttggctcgtggatcaagcgactcaatagttggctgcgaaaagagttttaatttttatgaggccgacgatgattacggcctcaggcgacaggcacaaatcggagagaaactatgtttgaaccaatggaacttaccaatgacgcggtgattaaagtcatcggcgtcggcggcggcggcggtaatgctgttgaacacatggtgcgcgagcgcattgaaggtgttgaattcttcgcggtaaataccgatgcacaagcgctgcgtaaaacagcggttggacagacgattcaaatcggtagcggtatcaccaaaggactgggcgctggcgctaatccagaagttggccgcaatgcggctgatgaggatcgcgatgcattgcgtgcggcgctggaaggtgcagacatggtctttattgctgcgggtatgggtggtggtaccggtacaggtgcagcaccagtcgtcgctgaagtggcaaaagatttgggtatcctgaccgttgctgtcgtcactaagcctttcaactttgaaggcaagaagcgtatggcattcgcggagcaggggatcactgaactgtccaagcatgtggactctctgatcactatcccgaacgacaaactgctgaaagttctgggccgcggtatctccctgctggatgcgtttggcgcagcgaacgatgtactgaaaggcgctgtgcaaggtatcgctgaactgattactcgtccgggtttgatgaacgtggactttgcagacgtacgcaccgtaatgtctgagatgggctacgcaatgatgggttctggcgtggcgagcggtgaagaccgtgcggaagaagctgctgaaatggctatctcttctccgctgctggaagatatcgacctgtctggcgcgcgcggcgtgctggttaacatcacggcgggcttcgacctgcgtctggatgagttcgaaacggtaggtaacaccatccgtgcatttgcttccgacaacgcgactgtggttatcggtacttctcttgacccggatatgaatgacgagctgcgcgtaaccgttgttgcgacaggtatcggcatggacaaacgtcctgaaatcactctggtgaccaataagcaggttcagcagccagtgatggatcgctaccagcagcatgggatggctccgctgacccaggagcagaagccggttgctaaagtcgtgaatgacaatgcgccgcaaactgcgaaagagccggattatctggatatcccagcattcctgcgtaagcaagctgattaagaattgactggaatttgggtttcgaggctctttgtgctaaactggcccgccgaatgtatagtacacttcggttggataggtaatttggcgagataatacgatgatcaaacaaaggacacttaaacgtatcgttcaggcgacgggtgtcggtttacataccggcaagaaagtcaccctgacgttacgccctgcgccggccaacaccggggtcatctatcgtcgcaccgacttgaatccaccggtagatttcccggccgatgccaaatctgtgcgtgataccatgctctgtacgtgtctggtcaacgagcatgatgtacggatttcaaccgtagagcacctcaatgctgctctcgcgggcttgggcatcgataacattgttatcgaagttaacgcgccggaaatcccgatcatggacggcagcgccgctccgtttgtatacctgctgcttgacgccggtatcgacgagttgaactgcgccaaaaaatttgttcgcatcaaagagactgttcgtgtcgaagatggcgataagtgggctgaatttaagccgtacaatggtttttcgctggatttcaccatcgattttaaccatccggctattgattccagcaaccagcgctatgcgatgaacttctccgctgatgcgtttatgcgccagatcagccgtgcgcgtacgttcggtttcatgcgtgatatcgaatatctgcagtcccgtggtttgtgcctgggcggcagcttcgattgtgccatcgttgttgacgattatcgcgtactgaacgaagacggcctgcgttttgaagacgaatttgtgcgtcacaaaatgctcgatgcgatcggtgacttgttcatgtgtggtcacaatattattggtgcatttaccgcttataaatccggtcatgcactgaataacaaactgctgcaggctgtcctggcgaaacaggaagcctgggaatatgtgaccttccaggacgacgcagaactgccgttggccttcaaagcgccttcagctgtactggcataacgacatttatactgtcgtataaaattcgactggcaaatctggcactctctccggccaggtgaaccagtcgtttttttttgaattttataagagctataaaaaacggtgcgaacgctgttttcttaagcacttttccgcacaacttatcttcattcgtgctgtggactgcaggctttaatgataagatttgtgcgctaaatacgtttgaatacgatcgggatggcaataacgtgagtggaatactgacgcgctggcgacagtttggtaaacgctacttctggccgcatctcttattagggatggttgcggcgagtttaggtttgcctgcgctcagcaacgccgccgaaccaaacgcgcccgcaaaagcgacaacccgcaaccacgagccttcagccaaagttaactttggtcaattggccttgctggaagcgaacacacgccgcccgaattcgaactattccgttgattactggcatcaacatgccattcgcacggtaatccgtcatctttctttcgcaatggcaccgcaaacactgcccgttgctgaagaatctttgcctcttcaggcgcaacatcttgcattactggatacgctcagcgcgctgctgacccaggaaggcactccgtctgaaaagggttatcgcattgattatgcgcattttaccccacaagcaaaattcagcacgcccgtctggataagccaggcgcaaggcatccgtgctggccctcaacgcctcacctaacaacaataaacctttacttcattttattaactccgcaacgcggggcgtttgagattttattatgctaatcaaattgttaactaaagttttcggtagtcgtaacgatcgcaccctgcgccggatgcgcaaagtggtcaacatcatcaatgccatggaaccggagatggaaaaactctccgacgaagaactgaaagggaaaaccgcagagtttcgtgcacgtctggaaaaaggcgaagtgctggaaaatctgatcccggaagctttcgccgtggtacgtgaggcaagtaagcgcgtctttggtatgcgtcacttcgacgttcagttactcggcggtatggttcttaacgaacgctgcatcgccgaaatgcgtaccggtgaaggtaaaaccctgaccgcaacgctgcctgcttacctgaacgcactaaccggtaaaggcgtgcacgtagttaccgtcaacgactacctggcgcaacgtgacgccgaaaacaaccgtccgctgtttgaattccttggcctgactgtcggtatcaacctgccgggcatgccagcaccggcaaagcgcgaagcttacgcagctgacatcacttacggtacgaacaacgaatacggctttgactacctgcgcgacaatatggcgttcagccctgaagaacgtgtacagcgtaaactgcactatgcgctggtggacgaagtggactccatcctgatcgatgaagcgcgtacaccgctgatcatttccggcccggcagaagacagctcggaaatgtataaacgcgtgaataaaattattccgcacctgatccgtcaggaaaaagaagactccgaaaccttccagggcgaaggccacttctcggtggacgaaaaatctcgccaggtgaacctgaccgaacgtggtctggtgctgattgaagaactgctggtgaaagagggcatcatggatgaaggggagtctctgtactctccggccaacatcatgctgatgcaccacgtaacggcggcgctgcgcgctcatgcgctgtttacccgcgacgtcgactacatcgttaaagatggtgaagttatcatcgttgacgaacacaccggtcgtaccatgcagggccgtcgctggtccgatggtctgcaccaggctgtggaagcgaaagaaggtgtgcagatccagaacgaaaaccaaacgctggcttcgatcaccttccagaactacttccgtctgtatgaaaaactggcggggatgaccggtactgctgataccgaagctttcgaatttagctccatctacaagctggataccgtcgttgttccgaccaaccgtccaatgattcgtaaagatctgccggacctggtctacatgactgaagcggaaaaaattcaggcgatcattgaagatatcaaagaacgtactgcgaaaggccagccggtgctggtgggtactatctccatcgaaaaatcggagctggtgtcaaacgaactgaccaaagccggtattaagcacaacgtcctgaacgccaaattccacgccaacgaagcggcgattgttgctcaggcaggttatccggctgcggtgactatcgcgaccaatatggcgggtcgtggtacagatattgtgctcggtggtagctggcaggcagaagttgccgcgctggaaaatccgaccgtagagcaaattgaaaaaattaaagccgactggcaggtacgtcacgatgcggtactggaagcaggtggcctgcatatcatcggtaccgagcgtcacgaatcccgtcgtatcgataaccagttgcgcggtcgttctggtcgtcagggggatgctggttcttcccgtttctacctgtcgatggaagatgcgctgatgcgtatttttgcttccgaccgagtatccggcatgatgcgtaaactgggtatgaagccaggcgaagccattgaacacccgtgggtgactaaagcgattgccaacgcccagcgtaaagttgaaagccgtaacttcgacattcgtaagcaactgctggaatatgatgacgtggctaacgatcagcgtcgcgccatttactcccagcgtaacgaactgctggatgtcagcgatgtgagcgaaaccatcaacagcattcgtgaagatgtgttcaaagcgaccattgatgcctacattccgccacagtcactggaagaaatgtgggatattccggggctgcaggaacgtctgaagaacgatttcgacctcgatttgccaattgccgagtggctggataaagaaccagaactgcatgaagagacgctgcgtgagcgaattctggcgcagtccatcgaagtgtatcagcgtaaagaagaagtggttggtgctgagatgatgcgtcacttcgaaaaaggcgtcatgctgcaaactctcgactctctgtggaaagagcacctggcggcgatggactatctgcgtcagggtatccacctgcgtggctatgcacagaaagatccgaagcaggaatacaaacgtgaatcgttctccatgtttgcagcgatgctggagtcgttaaaatatgaagttatcagcacgctgagcaaagtccaggtacgtatgcctgaagaggttgaggagctggaacaacagcgtcgtatggaagccgagcgtttagcgcaaatgcagcagcttagccatcaggatgacgactctgcagccgcagctgcactggcggcgcaaaccggtgagcgcaaagtaggacgtaacgatccttgcccgtgcggttctggtaaaaaatacaagcagtgccatggtcgcctgcaataaaagctaacagttgaagtaaaaggcgcaggattctgcgccttttttataggtttaagacaatgaaaaagctgcaaattgcggtaggtattattcgcaacgagaacaatgaaatctttataacgcgtcgcgcagcagatgcgcacatggcgaataaactggagtttcccggcggtaaaattgaaatgggcgaaacgccggaacaggcggtggtgcgtgaacttcaggaagaagtcgggattaccccacaacatttttcgctatttgaaaaactggaatatgaattcccggacaggcatataactctgtggttctggctggtcgaaagctgggaaggggagccgtggggtaaagaagggcaacccggtgagtggatgtcgctagtcggtcttaatgccgatgattttccgccagccaatgaaccggtaattgcgaagcttaagcgtctgtaggtcggataaggcgttcacgccgcatccgacatttgcacaagatgcctgatgcgacgctgtccgcgtcttatcaggcctacgtgcggcatcagacaaatgtcactgctttggctcttcgctccagtcatcgctttcggaaagatcgccactgctggggattcgtttttcttcagcagcccattctccgaggtcgatcagctgacaacgtttggagcaaaatggccgaaacgggctgatttcaccccacaccaccgttttcccgcaggttgggcaattcaccgtaatagtttctgacattttcactccttagcaacaggccagttcgaaatccagacgttccggtacctgtccgttttcagtgtccagcggcataaaacgaatggcaaaacggctcttatgtccggaaatttgcggataaagctgtgaatcgagcgacagattcaggcgcagcaagtcggcatcgccaccgttatcctgataaaaaccattcaggctggtttgtttacggaagggggccgactggcgaattaaatccagcaccatggtaagtgcctgggtgagcgggttcaggctggcaatccaggtttctacctggctgtcgcgctgcgcctggggtagatgcagccaaatgtgcaatgtaggtaaatcaaagctgcaacagccgcctgggatgctcagtcgctgacgcaccagagcaatcaaacgatcttcacgcagaaattgcccgatacgcggcgcggaaattaatacgctccccgccgcttttaactgctgaattaatgcttcaatacggctctggtccacgccaggcacgccaatccaggtctggagtttacgttgctgccggtcaagttctttcaacagctcagtgcggacttcgccgcgctcgaaaacatccagtaattcactgacattacggaagaaatgcagcgcgccagcgtggtcaacgatgggtaaattaacggtgagttgctgaatcaaaaactcaatgcgcagccatgtacgcattttttcatttagtggatgttcaaaaaggacctgggtctgcattacggtttttcctgtgagacaaactgcgacgcaagctgcaaatagtgtgcgtgcaggcgggcaacatccgatgcgatagcatccggtgcgccgttattatcaatgacgtcatctgccacggcaaggcgggcttcgcgcgttgcctgagcagcaaggatttgttcgacatgctcgcgagttacatcatcgcgctgcatggtgcgcttaagttgcgtttctgggctgacatccaccaccagcactcgattcgcttttttatacagtgagttttctaccagcaatggcacaacccacagtacatagggggaagtagcttgctggatctggtgttgcgtctcttgctgaatcagcggatgcagcagggcgttaagccagtttttctcttccgggttggcgaagatccgctcgcgcaaggcccggcgctgcaatgttccatcagcagcaatcatgttagcgccaaagtgatcagcaatggcatgtagcgcaggtgcacctggttcaaccacctgacgcgcaataatatcggcatcaatgacgttaattccgagatcagcaaacgcattggcaacggtactcttgccactgccaatgcctcccgttaaggcaactatatacctcataatttatattcccgggaattcatcatgattatcaaaacgttaaaaatgagcgcacgaaagcgaaattgatgaaacgttcgctcactatttaccaggtaaatttatgggattgtagcgtaaaaaaagacaatttcgcagtcttgcgccgcattgattagtgcgtatgatagcgtcactggagttgcgctcttacccttatagccattaaccccaggaatccgcacatgcgtattgaagaagatctgaagttaggttttaaagacgttctcatccgccctaaacgctccactcttaaaagccgttccgatgttgaactggaacgtcaattcaccttcaaacattcaggtcagagctggtccggcgtgccaattatcgccgcaaatatggacaccgtaggtacattttctatggcctctgcgctggcttcttttgatattttgactgctgtgcataaacactattctgtcgaagagtggcaagcgtttatcaacaattcttccgctgatgtgctgaaacatgtgatggtttctaccggtacgtctgatgcggatttcgaaaaaactaaacagattctcgacctgaacccggcattaaacttcgtttgtattgatgtggcgaatggttattccgaacacttcgtgcagttcgttgcgaaagcgcgtgaagcgtggccgaccaaaaccatttgtgctggcaacgtagtgactggtgaaatgtgtgaggagcttatcctctccggtgctgatatcgttaaagttggcattggcccaggttctgtttgtacaactcgcgtcaaaacaggcgtcggttatccgcagctttctgcggtaatcgaatgtgccgatgcggcgcacggtctgggcggaatgatcgtcagcgacggtggctgcaccacgccgggcgatgtcgcaaaagcctttggcggcggtgccgatttcgtcatgcttggcggcatgctggcgggccacgaagagagcggcggtcgcatcgttgaggagaacggcgagaaatttatgctgttctacggcatgagctccgagtctgcgatgaaacgtcacgttggcggcgttgcggaatatcgcgcagcagaaggtaaaaccgttaagctgccgctgcgaggcccggttgaaaataccgcgcgtgatattttgggcggcctgcgttcagcttgtacatacgttggggcttcacgcctgaaagaactgaccaagcgcaccacatttatccgtgtgcaggaacaagaaaaccgcatcttcaacaacctgtaatcttccaacgctggtgtggagcaacacgccagcgttatcccatcccactcatcgcatcgcctaaatggaaaattggcagatacatcgccaccaccagcgtaccgataattcctcccgttatgatcagcaacgccggttccagtaaggctgcgaggttatccgccagcgccattgtgttatcccgatgatgatgggcgaggttgtctaacatgaggtccagcgagccggatgcctctcctgttctcactaattgcaaacagagcgggctaaactccccggtattttttagcgccagccagatgggatgaccgttactgatatcgtgctggatttgtgtcagaagttgcacccagtacgggcagcgcattgtttctctgacgctctctacgccctgcaaaaaagtaatgcctgcactttgtgtcagcgccagaatcgtaaaaatctgcgtgagtttttgtccccgcatcagtgaacccataatcgggatgcgtaacagcaatttctgccgcactataagccaggtcggtcggcgcatcagcaacttattggctatcgccagcagaaagccgaacaacaccagcagccagctccattcgccactaaagtctgccagcgtcatgatcccctgcgttagtgccggtagtggggtgttgaaggtcttatagatagcggcaaactccggcagaacaaaatgcagcattgccacaaccaccatgattgccatcgctaaaatgatgatgggataacgtaacgctgatttcactttgtcggtcaactgacgctgggctttttgctgacgcgccagttcaaagcagcattcatccagcttaccggtcagttcacccgtgcggatcatcgcctgatagagtggcggaaatacctctgaccagggtaataaggcattggaaaaagcaatgccctgttcgagatcgtgcgccagcgattgcagcaacgcttgccattgcttactgggatgctgttccgccagcagtgccagcccttcagaaagcgttaacccggctttgagtagcgtcgccagttgatgaatgacttccgcgcttttatctcctcgccactgcgcagaattgatggcgattcgcttcaggctaagtggggtaaccatctgttgctgtagtgccatgagcagcaaagcacggctctctgcccatagcatcccatcttgcgcattgccgtcgccggttatgccatgccagcgccagagttgcttactcgccatgcggcatccccagtacgcggattaactcttcaaaggtggttaagccttgctccacggccaggcagccgttttcaaaaagcgtacgcatacccgcctgtcgtgcgtgcgtttccagcgattcaacgtcggtattagcggaaataagctgacgaatgaccggcgttatgggcagaacttcaaataaggccgtacgaccataaaaaccgtggtagcaatgtacacaaccgggtgcctgccagtggggcagcggcgatggccatacattgtctggaatgtggatgggctccccttgctgccggcgacaatgtgggcaaagtttgcgtaccagacgctgggctattaccagcgtaagcgccgatgatagcatccagcgggcgacccccatttgctgtaaacgtaccagcgtttcgcaggtggaattagtgtgtagggtagacaacaccaggtgaccagtttgcgccgctttaatagcgatctctgctgtttcgccatcgcggatctctccgatcatgatgacgtcaggatcctggcgcaataacgcacgcaacacgccctgaaaggtgagtccggcacgcggatggatttgcgtctggtttagtccggctatggggatctcaaccggatcttcgacgctacaaatattaatgtcagcggtattcagcgtttgcagggcactataaagcgtgaccgttttgccgctgcctgtagggccagttaccagcaccagtccctgtggttgttgcaaggcatgagcaaagtccgccagttgtaacggctgcattccaagcgtgttgacatccagtgcctggctcacctgctgtaacaaccttaataccaccttttcaccaccccgacatggtaaggtcgcaatacgaaatgagacggcgtttcctgccagttcgacagtgaattgcccgtcctgcggcaggcgatgttccgcaatatccaggtttcccagcacttttaatctggcggttaatgcgactccggcatccggtgaaacatccggtaaaggatgcaatacgccgtcgatacgcaagcggatgcggtaggcattgtccgctggttcgatatgaatatcagacgcgcgttgttccagcgcagattgtaacgttcgagttagcaactctgctttgggctgatgcttctcctgaacagctacgggcaatgtctgttgtgtgcgactggcgtgaccttccatttgttggcgcgtccagcaggtgatctcaatacgtttggtggtagcgaaatgcaatgcgtccagtagctcatgcgaaggtgcatcgactaccgcaacatgaaccacctcttcgctggcatccagcaagactccatgataacgcagacacagggcagtgagctgtggaatattcattgccgctccttagttggcgtcatcaaagcggaagacatcttcgcaggcttgatgcaatgcgctgtcactttgaatattgcagttgcgcgtccagccggtgacgccgtttgcgttatcccaacccggtgtcatgacgacgcttagcccattgagactttcttgcccggtcagcgacaccacgccctttgccacactcatggctgaaacatagcgggtggtggtaggcgagggaatgccattgctgccaccgtcgcaggtatctaatccaccatgttccagcgcgcacaactctacggcggtacggtaaggcacaaaggtttgtagcatgtcggtgagtgcggctttgcgcaggtagttttgataagcgggaataccaatggcgcttaaaatggcaatgatgccaataaccaccatcagttcgataagtgtaaaaccgcgttgcttgtccatctgtttcgctccttgatttagttggcgctactttggcaaacgccatcagcacaggcgaggggcaaaaaacgaaacgggaaagcagattccgaggttttttatttcgttgcagcgaaagacaagaaatttgcgaggcgttacgaagaaagttggggaaggggagattatccgcccgcgatggagcggataaatctgtcaactattagcgaaaacgcattgaaaggtcgagtgcttgtacgtgtttagttagcgcaccgacggagataaagtccacgcccgtttcggcaaattcacgcagtgttttgtcagtgacgttgccagacacttccagtagcgccttgccgttggtgcgtttgacggcttcgcgcatctgttctgtttcgaagttatccagcatgatgatatcggctcctgctttcagggcttcatcaagttcttccagattctctacttcgacttctactggcgcatccgggtgcagccaggacgctttttcgaccgcctggcgcactgagccggaggcaataatatggttttctttgatcaggaaggcatcagaaagccccagacggtgattcgctccgccgccgcaaagtaccgcgtatttcagagctgaacgcaggccgggtaaggttttgcgcgtatccaacaactgcgtgttggtgccttccagcaattcgacatagtggcgtaccttactggcaactcctgaaagggtttgcacaaaattaagcgcagtgcgttcgcccgttaacagcacgcgggatgggccttcaagttcgaacaaggattgattggcattgatgacatcgccgtcatccacatgccagattatggtgacatcgtcgcctgccagttgaataaacacctcttcaacccagcgtttgccgcaaaagacgccattctcgcgggtgatcaccgtggcatgagagcgagaattttccggtaaaagttttgccgtaatatcattgttgacatcgactgttccgcctaaatcttcccgcagcgcctgggccaccgcgccggggatatcgagattaatgcgttccagcagctcgtcacgtcgggtgtcagggttatagcggcgaggcggcatgttaaaactccagatagctaacgaatcataaggtagaaacatgctactctgaaccgggtattagcaccacatataaggagatcctgcatgttgttagaacaggggtggctggttggcgcgcgccgcgttccctcaccacattacgattgccgcccggatgacgaaacacccaccctgctggtggtgcacaatattagcctgccgccaggcgagtttggcggtccgtggatcgacgcattattcactggaactattgatccgcaggcacatcctttctttgctgagatcgcccatttgcgcgtctccgctcactgtttgattcgccgtgatggtgaaatagtccagtatgttcctttcgataaacgtgcatggcatgcgggagtctctcagtatcaggggcgcgaacgctgcaatgatttttctattgggattgagcttgaaggcaccgatacgctggcgtataccgatgcgcagtatcaacagcttgcggcggttacgcgggcactgattgattgctatccggatatcgctaaaaacatgacgggccattgtgatattgcgccggatcggaaaaccgatcccggtcctgcatttgattgggcacggtttcgtgtgctggtcagcaaggagacaacatgacgctatttacaaccttactggtgttaattttcgagcgcctgtttaagttgggcgagcactggcagcttgatcatcgtcttgaagcgttctttcggcgggtgaaacatttttctctcgggcgcacgttaggcatgaccattattgcgatgggcgtgacttttttactgttacgcgcattgcagggagtattgttcaacgttcccacgctactggtgtggctgctgattggtttgctgtgtattggcgcaggtaaagttcgtcttcattatcatgcttatctgacagctgcttcacgtaatgatagccatgcccgtgccacgatggctggcgaactcaccatgattcacggcgtcccggcaggctgcgacgaacgtgagtatttgcgtgagctgcaaaatgcattgctgtggattaactttcgtttttatcttgcaccgctgttctggctgattgtggggggaacctggggacccgttacgctgatggggtatgcgtttttgcgtgcatggcaatactggctggcgcgatatcagacgccgcatcatcgtttacagtccggcattgatgccgtgcttcatgtactggattgggtgccggttcgtcttgcgggtgtggtatatgccttgatcggtcatggtgagaaagcgttaccggcctggtttgcttcgctgggtgatttccatacttcgcagtatcaggtgttaacgcgtctggcgcagttctctctggcgcgtgaaccgcatgtcgataaggtggagacgccgaaggcagcggtttcaatggcgaagaaaacctcgttcgtggtcgtggtggtgattgcactactgacgatttacggggcgttggtgtaaagattattgccctcaccctgtacgggtgagggcgtagagagattaatgcgcttttacggctttggcggttttctctttaaacagatagccgatacctaacacgatcagccataccgggatcaggtataccgaaatcgccattcctggggtcatcagcataatcaccagtaccgccgccataaacagcaggcagatccagttacccagcggataaagcagagcagggaagcgagttaccacgccttgttcctgcttggcgcgacggaatttcatatgcgccaggctaatcatcgcccagttgattaccagtgcagataccaccagcgccattaacagtccgaaagcggactctggggcaaggtagttaatcagtacgcacaacgccgttaccagtgcagacaccagaatggtatttactggtacaccacgtttatcgacagacgccagcgcttttggcgcattaccctgttgtgccagaccaaacagcatacggctgttgcaatatacgcagctgttgtacacggagagcgccgcagtcagtaccacgatgttcagcgcattcgccacaaaggtatcgcctaactcgtggaagatcagcacaaacggactggtatcggcggtaacgcgggtccacggcatcagtgagagcagaacggctaacgaaccaatatagaaaatcaggatgcggtagataacctggttagttgctttcggtatactttgctccgggttatcagcttctgctgcggtgatccccaccagttccagaccaccgaacgagaacatgataatcgccatcatcatcaccagcccggtgaagccgtgcggcaggaaaccaccctgatcccacaggttgctaacggtcgcctgcgggccgccgttgccactgaatagcagccagccgccgaagatgatcatcgctaccaccgcgataactttgataatggcaaaccagaactccatctcgccaaacactttaacgttggtcaggttgatggcgttaatcaccacaaagaatacggcggcagaaacccaggtggggatttccggataccagaactgaatgtatttacccacggcagtcagctcagccatggcaactaaaacgtacagtacccagtagttccagccagaggcgaaaccggcaaaactgccccagtatttataagcaaagtggctaaaggagcctgcgacaggttcttcgaccaccatttcacccagctgacgcatgatcagaaaggcgataaaaccagcaatggcgtaacccaggataatccctggccctgcggactgtattacggaggcgctacccaggaataacccggtccctatcgcgccacccagcgcgataagctgaatatggcggtttttaaggccgcgctttagctgctcgccgtgctgttgaccttccatcatgaaacctcgtgcggtggttgtttttttgatctacgcagtgatgcgtgtgtaagtttgcaattccgtttgttgtattaatttgtttacatcaaagaagtttgaattgttacaaaaagacttccgtcagatcaagaataatggtatgcggcagcgaatgcacccgctttatgcatggttgaagatgagttgcttaaaaagaaaccgtttgtaaagctcagcctcaacccctctcaatatgtagaatgaatttaaattcgttttaattgaattaaaaatcacaaaattggtaagtgaatcggttcaattcggatttttatagtttaataatcgttaaaaaactcctttcctacgtaaagtctacatttgtgcatagttacaactttgaaacgttatatatgtcaagttgttaaaatgtgcacagtttcatgatttcaatcaaaacctgtatggacataaggtgaatactttgttactttagcgtcacagacatgaaattggtaagaccaattgacttcggcaagtggcttaagacaggaactcatggcctacagcaaaatccgccaaccaaaactctccgatgtgattgagcagcaactggagtttttgatcctcgaaggcactctccgcccgggcgaaaaactcccaccggaacgcgaactggcaaaacagtttgacgtctcccgtccctccttgcgtgaggcgattcaacgtctcgaagcgaagggcttgttgcttcgtcgccagggtggcggcacttttgtccagagcagcctatggcaaagcttcagcgatccgctggtggagctgctctccgaccatcctgagtcacagtatgacttgctcgaaacacgacacgccctggaaggtatcgccgcttattacgccgcgctgcgtagtaccgatgaagacaaggaacgcatccgtgaactccaccacgccatagagctggcgcagcagtctggcgatctggacgcggaatcaaacgccgtactccagtatcagattgctgtcactgaagcggcccacaatgtggttctgcttcatctgctaaggtgtatggagccgatgttggcccagaatgtccgccagaacttcgaattgctctattcgcgtcgcgagatgctgccgctggtgagtagtcaccgcacccgcatatttgaagcgattatggccggtaagccggaagaagcgcgcgaagcatcgcatcgccatctggcctttatcgaagaaattttgctcgacagaagtcgtgaagagagccgccgtgagcgttctctgcgtcgtctggagcaacgaaagaattagtgatttttctggtaaaaattatccagaagatgttgtaaatcaagcgcatataaaagcgcggcaactaaacgtagaacctgtcttattgagctttccggcgagagttcaatgggacaggttccagaaaactcaacgttattagatagataaggaataacccatgtcagaacgtttcccaaatgacgtggatccgatcgaaactcgcgactggctccaggcgatcgaatcggtcatccgtgaagaaggtgttgagcgtgctcagtatctgatcgaccaactgcttgctgaagcccgcaaaggcggtgtaaacgtagccgcaggcacaggtatcagcaactacatcaacaccatccccgttgaagaacaaccggagtatccgggtaatctggaactggaacgccgtattcgttcagctatccgctggaacgccatcatgacggtgctgcgtgcgtcgaaaaaagacctcgaactgggcggccatatggcgtccttccagtcttccgcaaccatttatgatgtgtgctttaaccacttcttccgtgcacgcaacgagcaggatggcggcgacctggtttacttccagggccacatctccccgggcgtgtacgctcgtgctttcctggaaggtcgtctgactcaggagcagctggataacttccgtcaggaagttcacggcaatggcctctcttcctatccgcacccgaaactgatgccggaattctggcagttcccgaccgtatctatgggtctggggccgattggtgctatttaccaggctaaattcctgaaatatctggaacaccgtggcctgaaagatacctctaaacagaccgtttacgcgttcctcggcgacggtgaaatggacgaaccggaatccaaaggtgcgatcaccatcgctacccgtgaaaaactggataacctggtcttcgttatcaactgtaacctgcagcgtcttgacggcccggtcaccggtaacggcaagatcatcaacgaactggaaggcatcttcgaaggtgctggctggaacgtgatcaaagtgatgtggggtagccgttgggatgaactgctgcgtaaagataccagcggtaaactgatccagctgatgaacgaaaccgttgacggcgactaccagaccttcaaatcgaaagatggtgcgtacgttcgtgaacacttcttcggtaaatatcctgaaaccgcagcactggttgcagactggactgacgagcagatctgggcactgaaccgtggtggtcacgatccgaagaaaatctacgctgcattcaagaaagcgcaggaaaccaaaggcaaagcgacagtaatccttgctcataccattaaaggttacggcatgggcgacgcggctgaaggtaaaaacatcgcgcaccaggttaagaaaatgaacatggacggcgtgcgtcacatccgcgaccgtttcaatgtgccggtgtctgatgcagatatcgaaaaactgccgtacatcaccttcccggaaggttctgaagagcatacctatctgcacgcacagcgtcagaaactgcacggttatctgccaagccgtcagccgaacttcaccgagaagcttgagctgccgagcctgcaagacttcggcgcgctgctggaagagcagagcaaagagatctctaccactatcgctttcgttcgtgccctgaacgtaatgctgaagaacaagtcgatcaaagatcgtctggtaccgatcatcgccgacgaagcgcgtactttcggtatggaaggtctgttccgtcagattggtatttacagcccgaacggtcagcagtacaccccgcaggaccgcgagcaggttgcttactataaagaagacgagaaaggtcagattctgcaggaagggatcaacgagctgggcgcaggttgttcctggctggcagcggcgacctcttacagcaccaacaatctgccgatgatcccgttctacatctattactcgatgttcggcttccagcgtattggcgatctgtgctgggcggctggcgaccagcaagcgcgtggcttcctgatcggcggtacttccggtcgtaccaccctgaacggcgaaggtctgcagcacgaagatggtcacagccacattcagtcgctgactattccgaactgtatctcttacgacccggcttacgcttacgaagttgctgtcattatgcatgacggtctggagcgtatgtacggtgaaaaacaagagaacgtttactactacatcaccacgctgaacgaaaactaccacatgccggcaatgccggaaggtgctgaggaaggtatccgtaaaggtatctacaaactcgaaaccattgaaggtagcaaaggtaaagttcagctgctgggctccggttctatcctgcgtcacgtccgtgaagcggcagagatcctggcgaaagattacggcgtaggttctgacgtttatagcgtgacctccttcaccgaactggcgcgagatggtcaggattgtgaacgctggaacatgctgcacccgctggaaactccgcgcgttccgtatatcgctcaggtgatgaacgacgctccggcagtggcatctaccgactatatgaaactgttcgctgagcaggtccgtacttacgtaccggctgacgactaccgcgtactgggtactgatggcttcggtcgttccgacagccgtgagaacctgcgtcaccacttcgaagttgatgcttcctacgtggttgtagcggcgctgggcgaactggctaaacgtggcgaaatcgataagaaagtggttgctgacgcaatcgccaaattcaacatcgatgcagataaagttaacccgcgtctggcgtaagaggtaaaagaataatggctatcgaaatcaaagtaccggacatcggggctgatgaagttgaaatcaccgagatcctggtcaaagtgggcgacaaagttgaagccgaacagtcgctgatcaccgtagaaggcgacaaagcctctatggaagttccgtctccgcaggcgggtatcgttaaagagatcaaagtctctgttggcgataaaacccagaccggcgcactgattatgattttcgattccgccgacggtgcagcagacgctgcacctgctcaggcagaagagaagaaagaagcagctccggcagcagcaccagcggctgcagcggcaaaagacgttaacgttccggatatcggcagcgacgaagttgaagtgaccgaaatcctggtgaaagttggcgataaagttgaagctgaacagtcgctgatcaccgtagaaggcgataaagcgtctatggaagttccggctccgtttgctggcaccgtgaaagagatcaaagtgaacgtgggtgacaaagtgtctaccggctcgctgattatggtcttcgaagtcgcgggtgaagcaggcgcggcagctccggcggctaaacaggaagcggctccggcagcggcccctgcaccagcggctggcgtgaaagaagttaacgttccggatatcggcggtgacgaagttgaagtgaccgaagtgatggtgaaagtgggcgacaaagttgccgctgaacagtcactgattaccgtagaaggcgacaaagcttctatggaagttccggctccgtttgcaggcgtcgtgaaggaactgaaagtcaacgttggcgataaagtgaaaactggctcgctgattatgatcttcgaagttgaaggcgcagcgcctgcggcagctcctgcgaaacaggaagcggcagcgccggctccggcagcaaaagctgaagctccggcagcagcaccggctgcgaaagcggaaggcaaatctgaatttgcagaaaacgacgcttacgttcacgcgactccgctgatccgccgtctggcacgcgagtttggcgttaacctggcgaaagtgaagggcactggccgtaaaggtcgtatcctgcgcgaagacgttcaggcttacgtgaaagaagctatcaaacgtgcagaagcagctccggcggcgactggcggcggtatcccaggcatgctgccgtggccgaaggtggacttcagcaagtttggtgaaatcgaagaagtggaactgggccgtatccagaaaatttctggtgcgaacctgagccgtaactgggtgatgatcccgcatgttactcacttcgacaaaaccgatatcaccgagctggaagcgttccgtaaacagcagaacgaagaagcggcgaaacgtaagctggatgtgaagatcaccccggttgtcttcatcatgaaagccgttgctgcagctcttgagcagatgcctcgcttcaacagttcgttgtcggaagacggtcagcgtctgaccctgaagaaatacatcaacatcggtgtggcggtggataccccgaacggtctggttgttccggtattcaaagacgtcaacaagaaaggcatcatcgagctgtctcgcgagctgatgactatttctaagaaagcgcgtgacggtaagctgactgcgggcgaaatgcagggcggttgcttcaccatctccagcatcggcggcctgggtactacccacttcgcgccgattgtgaacgcgccggaagtggctatcctcggcgtttccaagtccgcgatggagccggtgtggaatggtaaagagttcgtgccgcgtctgatgctgccgatttctctctccttcgaccaccgcgtgatcgacggtgctgatggtgcccgtttcattaccatcattaacaacacgctgtctgacattcgccgtctggtgatgtaagtaaaagagccggcccaacggccggcttttttctggtaatctcatgaatgtattgaggttattagcgaatagacaaatcggttgccgtttgttgtttaaaaattgttaacaattttgtaaaataccgacggatagaacgacccggtggtggttagggtattacttcacataccctatggatttctgggtgcagcaaggtagcaagcgccagaatccccaggagcttacataagtaagtgactggggtgagggcgtgaagctaacgccgctgcggcctgaaagacgacgggtatgaccgccggagataaatatatagaggtcatgatgagtactgaaatcaaaactcaggtcgtggtacttggggcaggccccgcaggttactccgctgccttccgttgcgctgatttaggtctggaaaccgtaatcgtagaacgttacaacacccttggcggtgtttgcctgaacgtcggctgtatcccttctaaagcactgctgcacgtagcaaaagttatcgaagaagccaaagcgctggctgaacacggtatcgtcttcggcgaaccgaaaaccgatattgacaagattcgtacctggaaagagaaagtgatcaatcagctgaccggtggtctggctggtatggcgaaaggccgcaaagtcaaagtggtcaacggtctgggtaaatttaccggggctaacaccctggaagttgaaggtgagaacggtaaaaccgtgatcaacttcgacaacgcgatcattgcagcgggttctcgcccgatccaactgccgtttattccgcatgaagatccgcgtatctgggactccactgacgcgctggaactgaaagaagtaccagaacgcctgctggtaatgggtggcggtatcatcggtctggaaatgggcaccgtataccacgcgctgggttcacagattgacgtggttgaaatgttcgaccaggttatcccggcagctgacaaagacatcgttaaagtcttcaccaagcgtatcagcaagaaattcaacctgatgctggaaaccaaagttaccgccgttgaagcgaaagaagacggtatttatgtgacgatggaaggcaaaaaagcacccgctgaaccgcagcgttacgacgccgtgctggtagcgattggtcgtgtgccgaacggtaaaaacctcgacgcaggcaaagctggcgtggaagtggacgaccgtggtttcatccgcgttgacaaacagctgcgtaccaacgtaccgcacatctttgctatcggcgatatcgtcggtcagccgatgctggcacacaaaggtgttcacgaaggtcacgttgccgctgaagttatcgccggtaagaaacactacttcgatccgaaagttatcccgtccatcgcctataccgaaccagaagttgcatgggtaggtctgactgagaaagaagcgaaagagaaaggcatcagctatgaaaccgccaccttcccgtgggctgcttctggtcgtgctatcgcttccgactgcgcagacggtatgaccaagctgattttcgacaaagaatctcaccgtgtgatcggtggtgcgattgtcggtaccaacggcggcgagctgctgggtgaaatcggcctggcaatcgaaatgggttgtgatgctgaagacatcgcactgaccatccacgcgcacccgactctgcacgagtctgtgggcctggcggcagaagtgttcgaaggtagcattaccgacctgccgaacccgaaagcgaagaagaagtaattgttcgtttgccggaacatccggcaattaaaaaagcggctaaccacgccgctttttttacgtctgcaatttacctttcctgtcgccttgctccgcgctcagagagacgttcgcgtactgctgaccgttgctcgttattcagcctgacagtatggttactgtcgtttagacgttgtgggcggctctcctgaactttttcccgaaaaacctgacgttgttcaggtgatgctgattgaacacgctggcgggcgttatcacgttgctgttggttcagtgggcgctgctgtactttttccttaaacacctggcgctgctcaggcgaggctgactgaatacgctcacgcgctgcgtctcttcgctgctggatctgtgggttagtctgcattttctcgcggactgcctggcgctgctcaggcgaggcggactgaatacgctcacgcgctgcgtctcttcgctgctggatctgtgggttagtctgcattttctcgcggactgcctggcgctgctcaggcgaggccgactgataacgctgacgagcggcgtccttttgttgctgggtcagtggttggcgacggctgaagtcgcggaagtcgtcatagctcccatagttttcagcttcattaaaccgctgtgccgctgcctgacgttgggtatctcgtgtaatgacgggggcggcgtgtgttcgttgctgaaactgacttgctgccgcctgacgctggctgtcgcgtgttggagcaggtagctgcgtggcgctcattccgccgttgacatcggtttgatgaaaccgctttgccatatcctgatcatgatagggcacaccattacggtagtttggattgtgccgccatgccatattcttatcagtaagatgctcaccggtgatacggttgaaattgttgacgtcgatattgatgttgtcgccgttgtgttgccagccattaccgtcacgatgaccgccatcgtggtgatgataatcatcatcgtcatgatgatgatggtcatgatcgtcgtcgtcccagtcgatgctgctgaatagtgcgtacgtggtagcaacacccatgctatagccgaatccgcgcacaaagctgtcaataaacggttctccggctggtggtggcagataaaccggcggatacgcagtattggcccagttcccgtaaaccacggttgggttgtagttgggaatatagaccacatcaggattggcgggctcaatggaaatgacggttgttgcaggctctgtaatgacggggctggcagttgaaacggtattggatggtatgacgggagccgtgactgtctgtgttaccggtacagctttcttcgttgtggtaataactttctgttcggttgatgacttcagcgagccggtttgttgcgccagttgccgcaatcgctgtaccgagtccatcacgtcctgcggctgcgccagaaaagcatcgcccaggttttgcacccattgcgggttttcgcccatcaatgccatcaattgtggaaaggccaccagtgatttaacgctggcgtcccacggctggtcagataccgcctgaatagcagcatcgccttgtttaagtggattatcgtgcgaccattgcactgcttgagcaacgtttgccggataggttgatgccattaacacttgtgaaagcagagaatcggggtacagcgcgacaggcgcaacccattgatcgatttgtgcagtgctgaatgcggatttgacgacggcgggcgttacgggcggtgcggaaaccgttgcaggaagcgtaactgcggtgatgtcaggcgcagtctgttgtgtcgattgcggttccacaggcgcttccactgtgcggctttttatatatagcccggtagaggcggcacaaagcccggcactgcaaattagcgccagcacatggggtttaaacggcaaagtcattttcataattcggatctcaaggaaatcgcaatggtcggcgaactgccacccgcaggtgctgtgaatccgagtataaagaggcggtagtttaaattttgactaatcttgggattcgttgagaaaggtgattatcaccatgcgaattaacgaagtttttacggagggaaacaatctctagaccatccttaacgattcagccacttttttatgttgcttttttgtaaacagattaacacatcgtcaaaatcctgctattctgcccgttgcggtactgggcatttaccctacaaactgctgtctcacaggagcgtgaagagaatcgcctgccgcactatgacaatgagagcgaggagaaccgtcgtgctagaagaataccgtaagcacgtagctgagcgtgccgctgaggggattgcgcccaaacccctggatgcaaaccaaatggccgcacttgtagagctgctgaaaaacccgcccgcgggcgaagaagaattcctgttagatctgttaaccaaccgtgttcccccaggcgtcgatgaagccgcctatgtcaaagcaggcttcctggctgctatcgcgaaaggcgaagccaaatcccctctgctgactccggaaaaagccatcgaactgctgggcaccatgcagggtggttacaacattcatccgctgatcgacgcgctggatgatgccaaactggcacctattgctgccaaagcactttctcacacgctgctgatgttcgataacttctatgacgtagaagagaaagcgaaagcaggcaacgaatatgcgaagcaggttatgcagtcctgggcggatgccgaatggttcctgaatcgcccggcgctggctgaaaaactgaccgttaccgtcttcaaagtcactggcgaaactaacaccgatgacctttctccggcaccggatgcgtggtcacgcccggatatcccactgcacgcgctggcgatgctgaaaaacgcccgtgaaggtattgagccagaccagcctggtgttgttggtccgatcaagcaaatcgaagctctgcaacagaaaggtttcccgctggcgtacgtcggtgacgttgtgggtacgggttcttcgcgtaaatccgccactaactccgttctgtggtttatgggcgatgatattccacatgtgccgaacaaacgcggcggtggtttgtgcctcggcggtaaaattgcacccatcttctttaacacgatggaagacgcgggtgcactgccaatcgaagtcgacgtctctaacctgaacatgggcgacgtgattgacgtttacccgtacaaaggtgaagtgcgtaaccacgaaaccggcgaactgctggcgaccttcgaactgaaaaccgacgtgctgattgatgaagtgcgtgctggtggccgtattccgctgattatcgggcgtggcctgaccaccaaagcgcgtgaagcacttggtctgccgcacagtgatgtgttccgtcaggcgaaagatgtcgctgagagcgatcgcggcttctcgctggcgcaaaaaatggtaggccgtgcctgtggcgtgaaaggcattcgtccgggcgcgtactgtgaaccgaaaatgacttctgtaggttcccaggacaccaccggcccgatgacccgtgatgaactgaaagacctggcgtgcctgggcttctcggctgacctggtgatgcagtctttctgccacaccgcggcgtatccgaagccagttgacgtgaacacgcaccacacgctgccggacttcattatgaaccgtggcggtgtgtcgctgcgtccgggtgacggcgtcattcactcctggctgaaccgtatgctgctgccggataccgtcggtaccggtggtgattcccatacccgtttcccgatcggtatctctttcccggcgggttctggtctggtggcatttgcagccgcaacaggcgtaatgccgctggatatgccggaatccgttctggtgcgcttcaaaggcaaaatgcagccgggcatcaccctgcgcgatctggtacatgccattccgctgtatgcgatcaaacaaggtctgctgaccgttgagaagaaaggcaagaaaaacatcttctctggccgcatcctggaaattgaaggtctgccggatctgaaagttgagcaggcatttgaactgaccgatgcgtccgccgagcgttctgccgctggttgtaccatcaagctgaacaaagaaccgatcatcgaatacctgaactctaacatcgtcctgctgaagtggatgatcgcggaaggttacggcgatcgtcgcaccctggaacgtcgtattcagggcatggaaaaatggctggcgaatcctgagctgctggaagccgatgcagatgctgaatacgcggcagtgatcgacatcgatctggcggatattaaagagccaatcctctgtgcaccgaacgacccggatgacgcgcgtccgctgtctgcggtacagggtgagaagatcgacgaagtatttatcggttcctgcatgaccaacatcggtcacttccgtgctgcgggtaaactgctggatgcgcacaaaggccaactgccgacccgcctgtgggtggcaccgccaacccgtatggacgccgcgcagttgactgaagaaggctactacagcgtcttcggtaagagtggtgcgcgtatcgagatccctggctgttccctgtgtatgggtaaccaggcgcgtgtagcagacggtgcgacggtggtttccacctctacccgtaacttcccgaaccgtctgggtactggcgcgaatgtcttcctggcttctgcggaactggcggctgttgcggcgctgattggcaaactgccgacgccggaagagtaccagacctacgtggcgcaagtagataaaactgccgttgatacttatcgttatctgaacttcaaccagctttctcagtacaccgaaaaagccgatggggtgattttccagactgcggtgtaataagtaagcgcacgcgctgcgcataaacgacacaatgcccggtgaatgagattcccgggcatttttttatttctaaaccatcgccgttccgctgtttttctccggtaaggctgcgataattacatcaatggcgcaatgcgatttcggcgcattgccgggagcagaggaacacactatggattacgaatttctgcgcgatattaccggagttgtaaaggtgcgtatgtccatggggcatgaagtggtcgggcactggtttaatgaagaggtgaaagaaaacctggccttgcttgatgaagtggaacaagcggcgcacgcactgaaaggtagcgaacgttcctggcagcgggcagggcatgagtacactctgtggatggacggtgaagaggtgatggttcgcgccaatcaactggaattcgctggcgatgaaatggaagaggggatgaactactacgacgaagaaagcctgtcgctatgcggcgttgaggattttctgcaggtcgtggcggcttaccgtaatttcgtgcagcagaagtaaataaatctggcggagcctgggagctccgcccgagacgttaaacagctggcatattgcgcccgtaataaatctcgcgcatttctttccacagcgcagcggtaatttcctggcgctcgctgtcggttaaatcttccggtttggtgtggaacatgtagtgcttaaggtcgaactctttaagcaacatcttggtatggaagatattttcctgatagacatttacatccaccatgtcatacagcgccttcatatcgtcagacataaagttctgaatcgaattaatctcatggtcgataaagtgtttcataccgttaatgtcgcgagtaaaaccgcgcacgcgataatcaatggttacgatatcggactcaagctggtggatcaggtaattcagcgccttcagcggagaaatcacgccgcaggtagagacttcaatatcggcgcggaaggtacataaaccgccttcaggatgactttccgggtaggtatgtacgcaaatatgacttttatcgagatgggcaacgaccgtttctggcagtgggccggggtgttctgttttgtcgataagtttcgggtcgaccggttcttcactcaccagaatagtgacgctggcaccctgtggttcgtaatcctggcgggcgatgttaagaatattggccccgataatggaacaggtttctgacaggatttcggtcagacggttggcattatagagttcatcgatataagcaatataaccgtcgcgctcttcggcagttttggcgtagcagatatcgtaaatacaaaaactcagacttttggtcagattattaaagccatgcagtttcagttttttcaatttcttatcttctccttaggacggctgtgaagccagtgcgtcttgcagatactgaggtaaggcaaaagctgccgtatggattgccggattgtaataacggcatttcaggccagaagcgagaaaacgcgcctgaataatttcggttgagagatggcgtaaggcgtcgttatctgtcgcccatgcaaaagtcatgataccgccgtaataggtcggaatcgccgcctgataaaagccaacgtcgctgaagtaatggctgagtttgcgatggctgtcgatggcttcttcctgctgtaaaaagcagacgccgttttgtgcgacgaagataccgccaggattcaggcaacgtttgcagccttcataaaatgccgaagtgaaaaggctttcgccgggaccgataggatcggtgcagtcggagataatgacatcaaaggtctggctggtttgattaacgaaattgacgccatcgtcgatcaccagcttaaagcgcggatcgtcgtagctaccggcgttatggttgggtagatactgacggcagaacgatacgacacccgcatcgatttccaccatcgtgattgactcaacgtttttatgtcgggttacttcacgcagcatggcaccgtcgccgccgccgataatcagcacatgtttcgcgtgaccgtgggccagtagcggaacatgggtcatcatctcatgatagataaactcgtcgcgctcggtggtttgtactacgccatccagcgccattacgcgaccaaatgcagcgttctcaaaaatgatcagatcctggtgatcggtcttttcatgatacagaacgttatctaccgcaaagtactgcccaaactggtcgtgtagcgtttcatgccactgttttttttcggccatgggttgatacctcctttgttaacacccgtaaaaaaagggcgcaacataatagctaacattgaccgcggatgcacggtcaatatttctacaaaaaggtatcagggattatttgacgtaggcaagcaggcttaaggaatcgcgggccagggctttgcattttttagcgacaggaatgccaatgccgctgagatcgcggtagctgtcttcaccgagagctttcatgtcgaaggtgtcgtaattactgagatcccactggttttgctgggcgaaaaagaccagtgcgcgacgaatttgcccgttaggtaagttctggtaaccacaatcgttcttcagaaagacaaaaactgccgttaaatcggccatatcttcggcttcagactcgctgagcgcgtaactgtttgcgcaaacggccatcaggctgccgaataacactgttctgaaaaacgtcttcattgcttctaccaggggcttaaagaagataaacgttagcacactgcgagcgaggcgacgaccattattgtcgattaaattgtgtctgcggcttgaccttcccgtaaggggaaggactatgctcaacgtttgattttgtttcgcctgcttaagaataaggaaataactatgcaacgtcgtgatttcttaaaatattccgtcgcgctgggtgtggcttcagccttgccgctgtggagccgcgcagtctttgcggcggaacgcccaacgttaccgatccctgatttgctcacgaccgatgcccgtaatcgcattcagttaactattggcgcaggtcagtctacctttggcgagaaaactgcaactacctggggctataacggcaatctgctggggccggcggtgaaattacagcgcggcaaagcggtaacggttgatatctataaccaactgacggaagagacgacgttgcactggcacgggctggaagtaccgggtgaagtcgacggcggcccgcagggaattattccgccaggtggcaagcgctcggtgacgttgaacgttgatcaacctgccgctacttgctggttccatccacatcaacatggcaagaccgggcgacaggtggcgatggggttggctgggctggtggtaattgaagatgacgagatcctgaaattaatgctgccaaaacagtggggtatcgatgatgttccggtgattgttcaggataaaaaatttaacgctgatgggcagattgattatcaactggatgtgatgaccgccgccgtgggctggtttggcgatacgctgctgaccaacggtgcaatctacccacaacacgctgccccacgtggttggctgcgcctgcgtttgctcaatggctgtaatgcccgctcgctcaatttcgccaccagcgacaatcgcccgctgtatgtgattgccagcgacggtggtctgctacctgaaccggtgaaggtgagcgagctgccggtgctgatgggcgagcgttttgaagtgctggtggaggttaacgacaacaaaccctttgacctggtgacgctaccggtcagccagatggggatggcgattgcgccgtttgacaagccgcatccggtaatgcggattcagccgattgctattagtgcctccggtgctttgccagacacattaagtagcctgcctgcgttaccttcgctggaagggctgacggtacgcaagctgcaactttctatggacccgatgctcgatatgatggggatgcagatgctgatggagaaatatggcgatcaggcgatggccgggatggatcatagccagatgatgggccatatggggcacggcaatatgaatcatatgaaccatggcgggaagttcgatttccaccatgccaataaaatcaacggtcaggcgtttgatatgaataagccgatgtttgcggcggcgaaagggcagtacgaacgttgggttatctctggcgtgggcgacatgatgctgcatccgttccatattcacggcacccagttccgtatcttgtcagaaaatggcaaaccgccagcggctcatcgcgcgggctggaaagataccgttaaggtagaaggcaatgtcagtgaagtgctggtgaagtttaatcacaacgcaccgaaagaacatgcttatatggcgcactgccatctgctggagcatgaagatacggggatgatgttagggtttacggtataaaaagaccgtattcggaaatatgcccggatctctccgggcattatggttatttcacatcatccggcagcgcataagccacaatatagtcgcccatcttcgtaccaaatgaaccgtgaccgcctgcggagatcaccacatactgcttgccattcacttcataggtcattggcgtcgcctgaccacccgctggtaaacggccctgccacagtttttcaccgttgctcatgttgtaagcgcgcaggtagttatctgccgtagcagcgataaacagcacgttacccgccgtggagattggcccgcccagcataggcatacccatattgaacggcaccggtacaggcatcgggaacggcatactgtcttgcggcgtaccaatacgtttcttccacaccacttcattggttttcagatccagcgccgagatataaccccatgctggctgtttacacggcagaccaaacggtgagaggaacgggttgagcgtgacaccatacggtacaccgtactgtggctgaatgccggattccgtacccgtgcctttggcatctttcggctgctccatcgggttacccggaccgcgtgggatcagtttcgaaacaaacggcagtgccattgggttggcaattgccacttcacgatttggatcaacggaaatcccgccccattcaaacattcccaggttacccgggaagaccagcgtgccctgttcagatggcggcgtgaaaatgccttcatagcgcatctggtggaacatcacgcggcacaccagttggtcaaacatggtggctccccacatatccgcaccgctcaaatctttcttcggacggaagctcagttcagagaacggctgggtcggagtaacgtaatcgcctttcgcagcaccttgcggcaccggtttttccggggccggaaccaccagttcgccattgcgacgatcgagcacaaaaatgttgccggttttcgccggagcgtaaataactggcactttctgaccattaacggtgatgtccgccagcgtcggctgtgccggaagatccatgtcccacaggtcgtggtgaacggtctggtagctccacgccagtttcccggtagtggcattcagcgccagaatcgagctggcataacgttcctgttccggtgtgcggttaccgccccagatatccggcgtggtcacgcccatcggcagatagaccagatccagcttcgcgtcataggccgctggtgcccaggagtttggcgagttaaaggtaaaggtgtgttcgtcagacgggattgcgttcggatctttcgcgccgggatcaaaagcccacagcagctccccggtgttgacatcaaaaccacggatcacgccagacgtttcgcgggttgagaagttatcggtaactgaaccggccatcacgatggttttatcggtgataatcggtggcgaagtcggttcatacagacccggtttggtgtctggcatattgctttgcagattgagcacgcctttattggcgaaggtttcgcacagtttgccgttttcagcgttaatcgcaatcagtcgaccatcattgaccggaagaatgatacgacgcgggcaatccgccatcacttccggcgaagccgtttctgctttggcttcatgataagagacgccacggcaggttacgtgctggaaagactcgttagttttcagctcaggatcgtaatgccatttctctttgccgctggcggcatcgagcgcaaacaggcgctggtgagcggtacacaggtaaagggtgtcgcccactttaatcggcgtcacttcattggtgatttcgcccggatcgttcggctgcttcacatcgccagtacggaacacccaggcttctttcagattatggacgttatcggcgttaatttgtttcagaggtgaaaagcgttgaccttcctgattgcgaccataggcaggccagtcctgatcggcaacgggtgagatagcttccgcaggtgtggcattggcgcttaaggtgccgttgatttcctgcggatcgttaaatccggcccaggtcaggataccaccgctaatcagcagtgccaccaccagtgcggcaactgcgccgctggcaggaatgaccaggcgacgccagacaaacggcaggatcagccagatgccgaagaagaccagaatgtcgctgcgcggagtcagcgcccagaagtcgaaaccaacttcccagacgccccaaatcatggtgccgagcagcagggctgcgtacagccaaagcgcggcacgtttactgcgccacagcatccaggcgacgccgagcatcacaagaccagcgatagggtagtaccaggagccgccaatcgcgaccagccagcctccgccaatgagtagatacagcccgcaaagcgctgcaaaaagggctgttagcgtgacgagtaatcgtcgcgagcctgtattgttaattgccataaagagacaccatttcaattcattaatattttagtagcaattaattataggttttaacatgtgtgatcgtcatcacaattcgagctttattaacagattccgcgaatgaatagttttactggtatactgcgtgtcttgcgctttgttgcggtgccaaaacctgcccgtgcgaagtgatttgtttttaaatcatatggttagagatatgaaacatactgtagaagtaatgatccccgaagcggagattaaagcgcgtatcgccgaactgggtcgtcagattactgagcgttacaaagacagcggcagcgatatggtgctggttggtctgctgcgtggctcatttatgtttatggcggacctgtgccgtgaagttcaggtatctcatgaagtcgactttatgaccgcctccagctacggtagcggcatgtccaccacccgtgatgtgaaaatcctcaaagatctggatgaagatatccgtggcaaggacgtgctgattgttgaagatatcatcgactcggggaatacactgtcgaaagtgcgtgagatcttaagcctgcgcgaaccgaagtcgctggcgatttgtacgctgctggataaaccgtcccgtcgtgaagtgaacgtcccggttgaatttatcggtttctcgatcccggatgagtttgtggtgggttacggcattgattacgcacagcgttaccgtcatctgccgtatatcggcaaagtgattctgctggacgagtaagtgtgaagttgccggatgtgttgcatccggcatggcatttttatttgtggttggcgtgtttcagcttgaggttggaaatcccgtgacggtaacgttgctcaagggtttcgcggttggtcgctgtgacatccagatcacgcagcaagccgtcgtgaatgccgtaggcccagccgtgaatggtaactttctgcccgcgtttccacgctgattgcataatggtggagtggcccaggttataaacctgttccatgacgttcagttcacacaaggtatccagacggcgctcttgcggcatttcgccgagcaatgagctatgtttgaaccagatatcgcggatatgcagcagccagttgttgataagccccagttccgggttttcaactgcggcttgtacgccgccgcaaccgtagtggccacagataataatgtgttcaacttcgagtacatccactgcatactgaaccacggaaaggcagttcaggtcggtgtgaatgaccaggttagcaacattacggtgaacaaagagttcgcccggctcaagaccggttaaacgttctgcaggaacgcgactgtcggaacatccaatccatagaaagcgcggtttttgcgcttgtgccagtttctcaaaaaacccgggatcctcttccaccagcatttttgaccatagtgcattgttgctgatgagtgtatctatgtctttcatggaggttaacgacctgtaaccaaataattacgtttggctaatatagggcaactccgggacgatttaaaccacagataaagtgtaagaacgtaaggtaagtaaaaatttatgaccattgcactggaacttcaacagcttaaaaaaacttatccaggcggcgttcaggcgcttcgtggaatagatttgcaggtcgaagcgggtgatttttatgcgcttctcgggccgaacggggccgggaaatcgaccactatcggtattatcagctctctggtaaataaaacctccgggcgggtcagcgtatttggttacgatctcgagaaagatgtcgtgaacgctaaacgtcagttgggactggtgccgcaggaatttaacttcaacccgtttgaaaccgtgcagcaaattgtggtaaatcaggcagggtactacggtgtggagcgcaaagaggcgtacatccgcagcgaaaaatatcttaaacaactcgatctatggggaaaacgcaacgaacgtgcgcgtatgttatctggcgggatgaagcgccgtttaatgattgcccgtgcgttaatgcatgaacctaaactactgattctcgacgaaccgaccgcaggcgtggatattgaacttcgccgctcaatgtggggctttttgaaggatttaaacgacaaaggcaccaccatcattctcaccacacactacctggaagaagcagaaatgctgtgccgcaatatcggcattattcaacacggtgagctggtggaaaatacctcgatgaaggcgctgctggctaagctgaaatcggaaacctttattctcgatctcgcaccgaaaagtccgttaccgaagctcgatggctatcagtatcgactggtcgataccgcgacgctggaagttgaagtgctgcgtgagcaggggatcaacagcgtatttacgcagttaagtgagcagggcattcaggtattaagtatgcgtaacaaagctaaccgtctggaagagctgtttgtttcactggttaatgaaaaacaaggagatcgcgcatgatgcatctttactgggtggcgctaaaaagcatctgggcgaaagagatccatcgctttatgcgtatctgggtgcagacgctggtgccgccagtcatcaccatgaccctttactttattatcttcggtaacctgataggttcgcgtattggcgatatgcatggcttcagctatatgcagttcatcgtaccggggctgatcatgatgtcggtgatcaccaatgcctacgctaacgtcgcgtcatcattttttggtgccaagttccagcgtaatattgaagagctgctggtagcgccggttccgactcacgtcattattgccggatatgtcggcggtggcgtggcgcgtggtctgtttgttggcattctggtgacggcaatttcactgttttttgtgccgtttcaggtgcattcgtgggtattcgttgccttaaccctggtgctcacggcggtgctattctcccttgcgggtttgctgaacggcgtgtttgccaaaacgttcgatgacatcagcctggtgccaacctttgtgttaacgccactcacgtatttgggtggggtcttttactcactgactttgttgccgccgttctggcaagggctgtcgcacctgaacccaatcgtttatatgatcagtggtttccgctacggcttcctcggtatcaatgatgttccgctggtcactacctttggcgtactggtggtctttattgtggcgttttatttgatctgttggtcgctgatccaacgtggacgtggtttgcgtagctaaggctatttcctctcctctggatttgggggagaggagttttgacggctatcaccctttatcaacaatggtcagggtagactgattttcggctaaggaggaaggcgatgttaggttgggtaattacctgtcacgatgaccgggcgcaagagatactggatgcgctggagaaaaaacatggggcacttcttcagtgccgggccgtgaatttctggcgtgggttaagctctaatatgctcagccgcatgatgtgcgatgctctgcatgaagcggactctggtgagggtgtcatcttcttaaccgatatagccggagcgccaccgtaccgcgtggcttcattattaagccacaaacactcccgttgcgaagtgatttctggtgtcacgttaccgttaattgaacagatgatggcttgccgtgaaaccatgaccagttcagagtttcgcgagcgtattgtcgaactgggtgcgccggaggtgagtagtctttggcaccaacaacaaaaaaatccgcctttcgtcctcaaacataatttgtatgagtattaacccgcgattctgatggcgcttttgctacaataaaagcgttgtttcaccctcggttattttttcatgtacaaacaagctgttattctcctgctgatgctgtttaccgcaagtgtcagtgccgcgttacctgcccgttatatgcaaaccatcgaaaatgctgcggtctgggcgcaaattggtgacaagatggtgaccgtggggaatattcgggccggacaaatcattgccgtggagcccactgccgcaagttattacgcatttaattttggctttggcaaagggtttatcgataaaggtcatctcgagccggttcaggggcgacaaaaagttgaagacggtttgggtgacctcaacaagccgctgagtcatcagaacttagttacctggaaagatacgccggtttataacgcgccgagtgcgggcagtgcgccatttggggtactggtggacaatttgcgctacccgattttgcataaactgaaagacaggttaaatcaaacctggtatcagatccgtattggcgatcgactggcctatatcagcgcgctggatgcccaacccgataatggcctgccggtgctaacctatcaccatattctgcgcgatgaagaaaacacccgttttcgccatacttcgacgaccacctcggtacgcgctttcaataaccagatggcctggctgcgcgacaggggatacgcgacactgagcatggcgcagctggaaggttacgtgaagaataagatcaatctccctgcgcgagcggtggtgattacctttgatgatggcctcaagtcggtgagccgctatgcgtatcctgtattgaaacaatatggcatgaaggcgacggcgtttgttgttacctcgcgcatcaaacgtcacccgcagaagtggaacccaaaatcgctgcaatttatgagcgtttctgagcttaacgaaattcgcgatgtttttgattttcagtcacatacccattttttgcatcgggtggatggctatcgccgacccatattactgagccgtagtgagcacaatattctgtttgattttgcacgttcacgccgcgctctggcgcaatttaatccgcatgtctggtatctttcgtatccgtttggcggatttaatgacaaagccgtgaaggcagcaaacgatgccggatttcacctggcggtgacaaccatgaaaggcaaagtaaaaccgggggataatccgttgttactaaaacgactttatatcttaagaacggattcgctggagacgatgtcgcggctggtgagtaaccagccgcagggataacaatcaagcaacctgtaccggaatcgctttcgcggtacgtttcatttcattgtcgccttcaaaataggcgacattgggtcgccaggtgcgagcttcttcatctggcatggtaacgaagctggcgatgatgacaatatcgccgacgctggcgcagtgggccgccgcaccgttaacagaaataattctcgaaccgcgttctgccgcgatggcataagtggagaaacgcttgccgttggtgacattccagatatcgatggcttcgttttcgagaataccggctgcgtcaagaaaatcctggtcaatggcgcaagaaccttcatagtgcaggtccgcatgagtcactttcacgcggtggagtttgccctgcagcatcgtgcgaatcataacttctacctttctaccctgtcgttaacgaagcaggcggtgcctgctttgaggaaattctcacgcagtattgcccgatttttgatgagtgtctactcatctgatggcatttgcgtcagcagtttgcgtaccgcgccgaagcgtgccatgtatcgcctgtaacgaattgaaatttctctgaacgctgctcggtaaacactaaagaggcggctgacgacggcgcgccttgactggatactgccttcacgcaagacaacacggaagacagggaagatggatgcaccgagtaccacaccgcatgacgcggtatttaacaatttttaatgcatgcggagacggctcgcgactttctggagatacatttgccagtggaattacgagaactttgtgacctcaacacgcttcatttagagtcggggagtttcattgaagagagcctgaaaggacacagcacggacgtgctctattccgtgcaaatgcagggcaatcccggttatctgcatgttgtgattgaacaccaaagcaagccggataagaaaatggcctttcgcatgatgcgttattctattgctgccatgcaccggcatctggaggcggatcacgataagctgccgctggtggtgccgatactgttttatcagggcgaggccacaccttatccgctctcaatgtgctggtttgatatattttactcgccggagctggcacgacgcgtctataacagtcctttcccgctggtggatatcaccatcacaccggatgacgaaatcatgcaacatcggcggattgcgattctcgaactactgcaaaaacatattcgccagcgcgacttaatgttattgctggagcaactggtcacgctgattgacgaagggtacactagcggaagtcagttagttgccatgcaaaactatatgctgcaacgcggtcatactgaacaagcggatttgttttatggtgtgctgagagacagggaaacgggaggggagtctatgatgacgctggcgcagtggtttgaagagaaagggattgagaaggggattcagcagggaagacaggaggaaaggcaagaattcgccctgcgtcttctaagtaaaggaatgtctcgggaagacgttgcagagatggcaaatttacctcttgctgagattgataaggtaattaaccttatttaagttacctgtgttatgacagatgacgtggggtaaattaataactggcgccatcagccgtagcgccagttaagtattacgccagctcgaccattttgttgtcgatcaggcgagcatcgccaagccaggcggctaccagaattactgcccgtttgctggtttcagaaacttccagcaatgtgtcggcatcgcgaatctgaatatcatcggcgcggaagcctttttcattcagttcttgccccgcaatggtaataatttcatcgagatcccgttccccagcctgcaatttgtcggcaattgaacttaaaactttgtacagaccgggcgcaattttgcgttgttccgccgtcagataaccattacgggaactgagcgcaaggccatctttggcgcgcataattggcacaccgacaatctcaatatcgaagcccatatcggcaaccattttgcggatcagcgccagttgctgaaagtccttttcaccgaagcaggcgatgtccggctggaccaggttaaacagcttgctgacgatagtcgaaacgccgcgaaaatgccccggacggctcgcgccttccagcatggtcgaaagcccgggaacgtcaacgtaagtatgggtttcagtaccgttcgggtagatctcttttaccgaaggggcgaaaactaaatccactttacgtttgtttagcttctcgcagtcctcctgcaaggtccgtggataacgtgccagatcttccgggcggtcgaactgcatcgggttaacgaaaatactgacgacgaccacatcggcgcgggctttggcttcgtcgaccagcttcatatggccatcgtgcagattacccatagtaggcaccagcgccacgcgcttgccttccatacgcaggcggcgaatttgctgacgcagcagcggcagggtttcgataattaacacaacgtgactccttaatggaaactgtgttcttcgcccggataaacgccggactccacttcagccatatactgccgcacagccgcgcggatgtcgcccgtttcggcgaggaaatttttagcgaatttaggaatgtgaccgccggtaatgccgaaggcgtcgtgcatcacgaggatctgcccgtcagtgacgttgcctgcgccaatgccaataaccgggatcgccagtgcttcggtaatacgttttgccagttcaaccggcacgcattccagcaccagcagctgtgccccagcggcttctaaggctaatgcatcgctgagcagttgatcgcccgcttcatcgccgcgcccctgaactttgtagccaccgaaaatattcactgactgtggggttaaacctaagtgaccacatacaggaacggcacgttcggtcagcatttttacggtttcgaccagccactcaccgccctcaattttgaccatattggcaccggcacgcataaccgttgcggcgttttcaaaggcttgttccggcgtggcatacgccataaacggcaggtcagccaacagcaggcagtttggcgcgccgcgacgtacggcggcggtatgataggcgatatcctcgacggtaacgggaagggtggagtcgtggccctgaaccgtcatgcccagcgaatcgcctaccagcatgacgttaagtccttcatcagcaaatagtttcgcgaagctgtagtcgtaagcggtgatggtcgcgaaacgctttttatcctgcttacatttctgaagtgaagcaatggtggtcggtttcataacgtgtcctgataaatgatgtcgtgttgcctggcattttatcagtcacattggtgggggcaatgatttatcaattaccgcaccgccagatgatggcggtgcggtggacttattaagggtaggttacctggaaagtactggtggctttaaactcaccagcttctattggtatagttccatcctgttgtagcgtggcctggaaatggagagggtatgttatacctgtatcttgatccgggtaaactcctcctgttgtatcgtctttgcctctcgggtcgtaatctttataaacagaatttgaatcattaggtttcaatgtcattagaggatttttactagttgctaaaccttctatgagtacaccgactccttttgctgcgtcattacctgtgagagtattaccaaggagttgcccgttttcagtaccaacctttgttgaaactaattttgtctcaatattagtcacacgaacgcagttttgaagtgaaatatcaaaaggaaccggtgtggcaccgtttctgatttgttctgcactatattcacccatttttaccgtagaaccagtcacagaagttccactaagcatagcggtaaaacaagtgggattagtcaacttgacattgagcagatcgaaatcgattttgataaaataactatgctcatttataccttggcctgcgccataggctttaaatgaatacagataatttgatgagctggataatttgatctgttgagttactgttggatcaaagtttgtatctgtatagaattcaattgtaagggtctgataaataccacctacagcccagtatttacgggtgctattcgcattattgcaactccaatataacacgtcttcgcttggattataccacgaaaaatattgttctgcagagtcaccaatgtatatcccaggtgaactaacgttagttacggtaccgtaagctgaccacatgtttgaaattaataatgtgtaatacaaaccaggaactgatgtattaaataatttatgggagccatacattttacctgagtcaaccattgcattttcaatacgcattgcgctaccacttgtgctatcacttctgttgcaataaagaaaaccaccaccagaagcggtatctaactgactccactgtaattttacacctgtaggtccaagctgcgtcggtttgtagaaaactaaattatttgtacttgttgcatatctgaatatgacagtagcatcgccattcggccccgtttctctccatttttgatctgacggaccaacgccgtaactattcccaacaatatatcctacgttatcatcagtgccagcactcgcggtataacaactcaagcacagaattaaaaaaagaaaatgtctgaagaatttcttcattatcactccaccatctactgctgtaacagtcgcagttatttgttttgatctattattcgtagtacacatcaactaatatatgactcattacctggccagatatgacatccagcgcgggatcgattttttgcattctggcataaaatttccatgaagaattatgcagggcagaagtcattactggatacacggaacgagaatttcctgctgaactaataacattgaatatattggtcgggtcctgaatggaaaagagaacgacaccgacatttttagccccggttgcgacttcattggcaaatatttgccttgaacctgcagccatgacaccgctaagggctctaaaatcaatatgtaactgattaagcacatcgccagttccctgtaatgcacagtctgatactgtgacagtgaactcttttccacctggttgatagctttcaggagtaacattatctgaaaaatatcccaccccaacgacgccaagatcaatattaccctggttactgattccgcttttgcaagtgctgttttttacattggcaacaaggtcaatatcctgcccagcgatggctggataggtaatgggaaactgtagtgacagaaacagaattattctcttcatcagcttacgttgagtgggatgcatatatagttcctggatctgtcagtctgttagttataggttactgtaaatgtggcaggtgcagaaaatttacccgcagtgacattgcttacggtttgaatcgccacggataatctagacacttccgagccgttgataatactggttttcatattctgtcggtgacatctgttcgctagaaccatgccgacgcttactgttataaaacatttcgatgtaatcaaaaatatcactgcgggcttcttcccgcgttccgtagatctttttctttatccgttcacgtttcaacaactggaaaaaactttctgcaaccgcattatcatggcagttaccgcgacggctcatgctaccctccaggccgtgtgatttcaggaacgactgccactcatggcttgtgtactgactgccctgatccgaatgaaccagcacctgtttttcgggattacgccgccatacagccatcagcagtgcgttcaggacaatgtcctttgtcatccgggattgcatggaccagccgataattttgcgtgagaacagatcaacaacaacggcaagatacagccagccttcgtgggtcctgatgtaggttatgtccgttacccaacgctcatcaggagcatccggattgaactgtcgctggagcctgttgggtgacacgatactggcctcgcctttacgtgcccgcgggcttcggtatccgacctgagcctttattccgacacgtttcatcagtctccagactctgtttactccgcactgttgcccgctgtcacgcaaatccagatggattttgcgataaccatagacgcatcccgattccagccagaactgtttaatctgtcctgtcagtctcaggtctgcctgatggcgttgtgaatgcggctgctgaagccaggcgtaaaaaccactgggatgaacatccagcacccgacagagcaggcgaacaggccagcaacaggagttgtcacggataaaggcgtacctcagtcggacagctttgcgaagtacgccgcggctttttttaatatgtcccgttcgtcggtaacccgtttcagctctttctggagacggcggatctcggcctgagcatctgactgttctttattagtggaagaatccggaccgtacttctttatccaggcataaaggctgtgggtggtgatatcgagacgtgttgcaacgctggcaacagaataaccgcgatcaacaacctgtttgactgcttcagttttaaactcttcgggataacgcttaccgctcatgggcacctctctttaagccatcttaaatgactctgaggtgtctgttaaacccgtggcgattcaaatttttagttggttttatagtcacgttatgcttcctgcggaattatatccttgcctgattacagactggcattaccttcaatggcgccaccaaaatcattaatggcgtaaaaatgtacttttgcagaacttgctttgccattaaggccagtgactttcatgacctcatcactaaatggtgcaatcattttcacatcaatcggatagcgtttaccgctagcttctaaatcaccactgctaaaagagacgtagtaaggggttggattggtcactcgcaatgacgccttaccttctgaacctgaccagaaccacttcagggctaacggggcttcagagggatttcccttcaatccatccgggcgatagaaaagttttatacgtgtgcgaaatgccagttgcagcagactttgattcgcgaccttttctgcatctggttttggtggaacttccagtacgttaaaccagaacacgctctctctgtctttaggcagtgaggtgctggctgtgtacattaatttgattgtttgcccacgtttggcatcaatacgcgatactggcggcgtggcagtaaaagggactgtaatactgccaggctcagcgttgtcatcgccagtatctaaccaactctggacaagcaacgggttattccctttattttccagacgtacgttgacacttttttgatcgcttttatatattacgcgagtacccgaaatgacaatgtccgcaatagacgatgaactaaaagccatacaggttacgaagcataaagctgttgtatgtttgatgttaaaaaacataaaccatccctgacagagttaattaaaacagggaataatataaaaatagaaattattaatactattccctgtatattcattcaatcaatttaattggtgaatacttactgataagtaatggtgtatgcagtgttagtttttacataaccagcagttgctgtttggtctgcgacggcacgaacgtaagacgctttaaaatcataaacagcagattttgtcgttgcatccagggctttagtatacacatcgccagggttgttaatttgaacctgtttgatagtggaaccatcaatattgtgcagagcgatattcacgccgtcagaagggttgttaatagacatgtcgttgttcagcgttcctttgctattaccaaagaaaacagaaccgaaggtcattttagctgtactacctggattcggatttgctttgctgcagtcaacggtgatgctgaaaggtttggctttagcgccaacggtgtcattcagcacgccagcatcgatttcaccaacagttgcagtttgcagcaggatcagaccatctttattaccgccgtcaacgcgggtttcacaggtgttatcaacaaccagaccactgatatttaactgaccaccatccatatcagcagaagcagtacctgcaaccattgccagcataagaccagacagggcaaaacctaattttttagacataaaaatccttgaataaaattccattagtcagactactggtttgaagaatgactattcatgacacaaatgttataagcagatgctagatattaatgagcaatgatatttgttaccaaaatttacaaccattgttcattaggacgcctattgtgcactttaagggcttttgaacaaattaaattttcttaattcaaaattaagcaaaaataaattcacaagtgcaattggttagggtatggcgatgggattgatatttatctgcgggaatttatattatgtttctgcaaaaatgtttaaactaaaatttttattaaggaaagagaggatgtatgattttcagaaaatatttatattcgtaatataaataaattaccatttgcttaatttgtcaaatgctcttgtatgtaagacttcacgcaacgtctccccatcaggaaacgccagctccggtgcaatctcaaacagcggccacagcataaatccacgattcttcatatcgtagtgcggaacggtcaggcgttcggtatttatcacttcattaccaaacagcatgatatcgagatccagcgtgcgtggtccccagcgttcagctttacgaacacgaccctgttgcagttctatgcgctgtgtatggttgagtaactcttccggggcgagcgaagtttcaagcgccacggcggcgttgaggtaatcgggttgatcttgcggccccagcggtggagtgcggtaaatcgaagaaacggcaagaatgtggctttcagggatatcgcctaatgctttcagggcagcattgacctgctccagcggagaggccagattgctgcctatggcaatatacgccactgtcatgcggtaccctcacgacgcggtgcgcgtttgcgtggacgacgagtacggcgacgcggtgacggctcttcatccaactcgttaagcatccctttttgatctggtggcgcggaaacctggaactcaccccaccatttcaccagacgctgcagttcagcgttacgttcaacttcagctcgcaaggccaacaggtcataagccgcacggaacttaggatgctccagcagtttccatgcgcgtttaccctgacgacgggacatacgcaactgcaactgccagatatcgcgggttaacgtcgtcagacgtttcgggattgccagtgaacggcaggcttcgtccagcacgtcgttcatcgccagcgcgaaagcgtcgtgataggtcaggccgctttcctgggcaatcttctgtgccgtctccagcagtgggtaccagaacatggcggcaaacaggaacgccgggttcacgcgcatatcgttatggatacgcgtatcggtattcttcagcacctgttcaatgatccgctccatcgggctgtcgccattttccgtgaagtagcgggtaatggtcgggaacagcggctggaacagatgatattcacacaacagcttataggtatcgtaaccgtagcccgcttgtagcagtttaagcgattcttcaaacaggcgtgccggtgggatatcgttcaacagggtagcgaggcgagggatcggttctgcggtttccgggctgatgcgcatacccaatttggcggcaaaacgtaccgcgcgcagcatacgtaccggatcttcacggtagcgcgtttccgggttaccaatcagacggataacgccgtccttcagatccttcataccgccaacgtaatcacggacggtaaaatccgctacgctgtaatacaggctgttgatagtgaaatcgcggcgctgggcgtcttcttcgatggagccgaaaatgttgtcgcgcagcaacatgccgttttgcccgcgttgggaggtcgtgcggtcgctgacgttaccttcgtggtgtccacggaaggtcgcaacttcgataatctccgggccaaacattacatgagccagacggaaacggcgacccaccaggcggcagttacggaacagtttgcgcacctgctcaggcgtggcgttagtggttacgtcaaaatctttcggctttttgccaagtaacaggtcgcgcacgccgccgccaaccagccaggcttcgtatcccgctttgttgagcctgtacattaccttcagggcattttcactgatatctttgcgggaaatagcatgctgctcacgcgggatcaccgtcacctgtggacgggcgactgcctgttcagcctcgctttcctcgcggcttagcaccttgcggcaaaaattagcgactcgggtaaaaatagtacacctcggtagtgtcaaacatcattcaggacaaaaaaatagcggctaatcatagctcagcatgacgcatttgagaatgttgaatttacaattgccgactcgggcacggcggtaagccgccagtttttgacggctgactgaaggatttgctcgacgctgaaatcctgccagtgtgcttctgcctgctgccccagaaattgaagtgccgcgattagtaccgggcgtggatcgcctttcggcaacgcaggcgcatgattctgcttggaaagtttagcgccttgtggattaagcgccagcggcagatgaatgtaatctggcactttccagccaaaaagctggtacagcgagatttgccttactgttggttcaatcagatcagccccacgcactatttctgtaacgccctggaaatgatcatcaaccacaacagccaggttgtaggcgaacaacccatcacggcgatgaatgataaaatcttcccgtgccagtttttcgtcggcgtgaataatgccgcgcagctggtcagtaaattgcgtgaccggatgctgctggcggatacgcactgcggcgttgtctggtccatgatgcaacacccggcaatgaccgtcgtaaataccgccaatgctttgaatacgcgcacgcgtacaggtgcagtaataacttagtccttgttcatgtaaccaggcgagtgcttcacgataggcgtcgtgacgttgcgattgccagagaacatcgccgtcccagtgcagaccgtaatgttccagctggcgcaggatagtttctgcggcaccgggaacttcacgaggcgggtcgatatcttctatgcgtaccagccagcgaccttgccgggcgcgagcctgcaaatagctgccgagcgcggcgatcagagagccaaaatgaagctcgccggaaggagagggggcgaagcggccaatatactgtgtgtctgtcatctctttgaacaaaaaataaggcgggagcatttcccgcctgtggtaaacgtgatggaacggctgtaattagccagccatctgtttttcgcgaatttcagccagcgttttgcagtcgatgcacagatcggctgtcgggcgcgcttccagacggcgaataccaatttcaacaccgcaggattcgcagtagccgaaatcttcgtcttccacttttttcagcgtcttctcgatctttttgatcagcttacgctcgcgatcgcggttacgcagttcgaggctgaactcttcttcctgggctgcacggtctaccgggtccgggaagttggctgcttcatcctgcatatgtgtaacggtgcgatcgacttcatccctgagttgattacgccatgcttccagaatacgacggaagtgcgccagctgggcttcattcatatactcttcgcccggcttctcctgatatggttccaccccagcgatggcgagaatactcagggacgatgttttacggttttgcccttcttgcatgttgcttctccttaacacgcactatcgatccccatgttcgggggaaaaatgaggccgctataaatagcagatgcttttccggatagcaattatctaaacgtaacacttgacaactgtgtgaggaaaagcgtatttgcgcacgcgaccagaatgtaaattaaccagttacttactttactacaatgtaaccggcagtgattttttaagagccatgccttcagcagaaatttccgctttgtaagccagaatttctacccccctctgttgagcttctgacaatagttgcgcgtatttctcatcgatgtggcgcgcgggtgaaaaccgtgtaatggctgaatgcagcacggcgaaaaagataaccgcacgctggccttcagccgctacgctcatcaactcccgaaggtgtttctgacctcgttcagtgaccgcatcgggaaaatatccctgttcgttctccgctaacgtaaccgatttcacttcaatatagcagtctggacgcgaatccgcctgcaacataaagtcaatacggctgcgttctgcgccgtattttacttcgcttttcagcgagctatagcctgacagttctgaaattgattcattaaggatagcctctttcgtcaacctgttagcccaaagcgtgttgacgcaaataaatgcgccgctctggctttgagttaattcccaggtgtgtgggtatttccgtttggtgttgtctgaagtcgaataccagacggtatcgccaggcgttgcacaaccggtcattgcacccgtattcgggcagtgtagcgttaattcgcgaccatcgggtgtgatcacatcggctaaaaaacgtttgtaacgctgaattagcgtcgcgcgctgtagagggggagagaattccattgcgacaatccttgttattgcgttagcgcccagcgttttagcggcgtgtagcgtgtgcgtccacgggcaaacgaggaggcgtaaagggtgaactccgtcaccgcataagaccagttaaaacctggcggcgggattgtcaccgcctcgctggcgtcgcgcaataaggtaatatgtggatgaaacggacgattgctttgaaaacaaccgctgcgggcagcctgtgaacggagcatattcgccagctggattaagccgcgtggaggctgacgcatccctaaccacaccacacgcgaacgcagccattgtccggcgtcatcaagcgtgagtgtgaaaccaggttgacgaatccgtccggctaaaagagaaagcgccttctctttctcggcgctcacttcgcctaaaaatgccagagtcagatgcaaattatcggcggcgaccggacgtcccgcctcaggtgggaagtgtgtggcgcgccaatggataatctgttcgcggatttctgcaggtaagtcgatagcaaagaacagacgttgcggttcagacatgtgaggcactcggttatgaattaccgcgatgctacaatgtggcgcgaagaatgttaaccctctggagcgttttgtgtcgtcgttgcccgttgctggcgtcttatctgaattacttaccgctctcgattgtgcgccgcaggtattattaagtgcgccgaccggggccgggaaatcaacctggctgccgctgcaactgctggcgcatcccggcattaacgggaaaattatcctgctggagccgcgtcgtctggcggcgcgtaacgtcgcgcaacggctggcggagctgcttaacgaaaagccaggcgataccgttggctaccggatgcgtgcgcaaaactgcgtcgggccgaatacccgcctggaagtggttaccgaaggcgtgctgacgcgcatgatccagcgtgacccggaactgagcggtgttggactggtgatccttgatgaatttcatgagcgcagcttgcaggcggatttggcgttggcgctgttactcgatgtgcaacaaggtctgcgtgatgaccttaaactgctgattatgtcggctaccctggacaacgaccgcttgcagcaaatgctgccagaagcgcctgtcgtcatctcagaagggcgctcgtttccggttgaacgccgttatttaccgctgcccgcgcatcagcgttttgacgatgccgttgcggtagccaccgctgaaatgctgcgtcaggaaagcggatcattactgttatttttacctggcgtcggagaaattcagcgtgtgcaggaacaactggcttcgcgcatcggcagtgatgtattgctctgcccgctgtatggcgcgttgtcgctgaacgatcagcgaaaagcgatcctcccggcaccgcaagggatgcgcaaagtggtgctggcgaccaatattgctgaaaccagtttaaccattgaaggtattcgtctggtggtggattgtgcccaggagcgtgtggcgcgttttgatccgcgcacggggcttacgcgactgattactcaacgcgttagccaggcatccatgacgcagcgtgccgggcgcgccgggcgtctggagccgggtatctgcctgcatttaatcgccaaagaacaagcagaacgcgccgcggcgcaaagtgaaccggagatcttacaaagcgatctttccggtttgctgatggaattactgcaatggggatgcagcgatccggcgcagatgagctggctggatcaaccgccagtagtgaatctactggccgcgaaacgtctgttacaaatgctgggggcactggagggtgaacggcttagtgcgcaagggcaaaaaatggcagcgctgggtaacgatccgcgtttagcggcaatgctggttagcgcgaagaacgacgacgaagctgctaccgcggcaaaaattgccgccattctcgaagagccgccacggatgggcaatagtgacctgggcgtggcgttttcgcgcaatcaaccagcctggcagcaacgtagtcagcaactgttaaaacgcttaaacgtacgcggcggtgaggcagacagttcgcttatcgcgccgctacttgccggggcgtttgccgatcgcattgctcgccgccgtgggcaagatggacgctatcaactggcaaacggcatgggagcgatgctcgatgccgacgatgcgctaagccgccacgaatggttgatcgcaccgttattattgcagggcagcgcctcgccggatgcgcggattttactggcgctgccggtcgatattgatgagttagtacaacgctgcccgcagctggtacagcagtctgacactgtggagtgggatgacgcgcaaggtacgctgaaagcctggcgtcggctgcaaatcggtctgctgacggtgaaagtgcagccgctggcgaaaccctcggaagacgagttgcatcaggcgatgcttaacggcattcgtgataaaggtttaagcatactcaactggacggcggaagcggaacagctacgcttgcgtttgttatgcgccgcaaagtggttgccggaatatgactggcctgcggttgataatgaaagtttgttggcgacgctggaaacgtggctgctgccacatatgaccggcgtgcattcactacgcggcctgaaatcactcgacatttatcaggcactacgcggattacttgattggggaatgcagcaacgtctggatagtgaattgcctgcgcattacactgtgccgacgggaagccggatcgccattcgttatcatgaagataacccgcccgcgctggcggtgagaatgcaggagatgtttggtgaggccactaatccgacgatcgcccaggggcgcgtgccgctggtgctggagttgctttcccctgcccaaaggccattacaaatcacgcgtgatttgggggccttctggaaaggggcgtatcgtgaggtgcaaaaggagatgaaagggcgttatcccaaacacgtctggccggacgacccggcaaacacggcaccgacgcgacggacgaaaaagtattcgtaaggttggttttctccctctccctgtgggagagggccggggtgagggcatcagcgcgcacgttcaccctcaccctaaccctctccctcaagggagaggggaccgatcgagcacaaattttgagagatatcttcttctgtcttgtaacagaagaacagaaaatcgggcttttgcgcctgaatattgcggagaaaaagcatggccgggaatgaccgcgagccaattggacgcaaagggaaaccgacgcgtccggtcaaacaaaaggtaagccgtcgtcgttacgaagatgacgatgattacgacgattatgatgactatgaggatgaagaaccgatgccgcgcaaaggtaagggcaaaggcaaagggcgtaagcctcgtggcaaacgcggctggctatggctactgctaaaactggctatcgtttttgccgtgctgatcgccatttacggcgtttatctcgatcaaaaaattcgtagccgtattgatggcaaggtctggcaactgcctgcggcagtttatggccgaatggtcaatcttgagccagacatgaccatcagcaagaacgagatggtgaagctgctggaggcgacccagtatcgtcaggtgtcgaaaatgacccgtcctggcgaatttaccgtgcaggctaacagcattgagatgatccgccgtccgtttgatttcccggacagcaaagaagggcaggtgcgtgcgcgtttgacctttgatggcgatcatctggcgaccatcgtcaatatggagaacaaccgtcagttcggtttcttccgtcttgatccgcgtctgatcaccatgatctcctcgccaaacggtgagcagcgtttgtttgtgccgcgcagtggtttccctgatttgctggtggatactttgctggcgacagaagaccgccatttctacgagcatgatggaatcagtctctactccatcggacgtgcggtgctggcaaacctgaccgccggacgcacggtgcagggggcgagtacactgacgcaacagctggtgaaaaacctgttcctctccagcgagcgctcttactggcgtaaagcgaacgaagcttacatggcgctgatcatggacgcgcgttacagcaaagaccgtattcttgagctgtatatgaacgaggtgtatctcggtcagagcggcgacaacgaaatccgcggcttcccgctggcgagcttgtattactttggtcgtccggtagaagaattgagcctcgatcagcaggcgctgttagtcggtatggtgaaaggagcgtccatctacaacccgtggcgtaacccgaaactggcgctggagcgacgtaatctggtactgcgtctgctgcaacagcaacagattattgatcaagaactctatgacatgttgagtgcacgtccgctgggggttcagccgcgcggtggggtaatctctccacagccagcctttatgcaactggtgcgtcaggagctgcaggcaaaactgggcgataaggtaaaagatctctccggcgtgaagatcttcactacctttgactcggtggcccaggacgcggcagaaaaagccgccgtggaaggcattccggcactgaagaaacagcgtaagttgagcgatcttgaaactgcgattgtggtcgtcgaccgctttagtggtgaagttcgtgcgatggtcggtggttctgagccgcagtttgcgggctacaaccgtgcgatgcaggcgcgtcgttcgattggttcccttgcaaaaccagcgacttacctgacggctttaagccagccgaaaatctatcgtctgaatacgtggattgcggatgcgccaatcgcgctgcgtcagccgaatggccaggtctggtcaccgcagaacgatgatcgtcgttatagcgaaagtggcagagtgatgctggtggatgcgttgacccgttcgatgaacgtgccgacggtaaatctggggatggcgctggggctgcctgcggttacggagacctggatcaaactgggcgtgccgaaagatcagttgcatccggttccggcaatgctgctgggggcgttgaacttaacgccaatcgaagtggcgcaggcattccagaccatcgccagcggtggtaaccgtgcaccgctttctgcactgcgttcggtaatcgcggaagatggcaaggtgctgtatcagagcttcccgcaggcagaacgcgctgttccggcgcaggcggcgtatctgacactatggaccatgcagcaggtggtacaacgtggtacgggtcgtcagcttggggcgaaatacccgaacctgcatctggcagggaaaacagggactaccaacaataacgtagatacctggtttgcaggcattgacggcagcacggtgaccatcacctgggtaggccgtgataacaaccagccgaccaaactgtatggagccagcggggcaatgtcgatttatcagcgttatctggctaaccagacgccaacgccgctgaatcttgttccgccagaagatattgcagatatgggcgtggactacgacggcaactttgtttgcagcggtggcatgcgtgtcttgccggtctggaccagcgatccgcaatcgctgtgccagcagagtgagatgcagcagcagccgtcaggcaatccgtttgatcagtcttctcagccgcagcaacagccgcaacagcaacctgctcagcaagagcagaaagacagcgacggtgtagccggttggatcaaggatatgtttggtagtaattaacatctaagcgtgaaataccggatggcgagttgccatccggtaaaataacatcccatctaagatattaaccctttcttttcatctggttgtttattaacccttcaggaacgctcagattgcgtaccgcttgcgaacccgccagcgtttcgaatattatcttatctttataataatcattctcgtttacgttatcattcactttacatcagagatataccaatggcgcgttccaaaactgctcagccaaaacactcactgcgtaaaatcgcagttgtagtagccacagcggtaagcggcatgtctgtttatgcacaggcagcggttgaaccgaaagaagacactatcaccgttaccgctgcacctgcgccgcaagaaagcgcatgggggcctgctgcaactattgcggcgaagcactctgctactgcgactaaaacggatacaccaattgaaaaaacgccgcagtctatttcggttgtgacaaatgaagagatgcagatgcatcaatttcagtctgtaaaagaagcattaggttatacacctggcgttacggttagcagtcgtggtgcttctaatacatatgattttgttatcattcgtggtttctcatctgttggtctgaatcaaaataattaccttgatggactaaaacttcagggcaacttttataacgatgctgtgattgatccttacatgctcgagagggttgaactgatgcgtgggccgacgtctgttctctatggaaaaagtaatcctggtgggattatttctatggtgagtaagcgtccgaccactgaacccctgaaagaaattcagtttaaaatggggacggataatctgtttcagactggattcgatttcagtgatgcactggatgataacggtgagttctcctaccgtttgacgggcctcgctcgttcaacaaacgaacagcagaaaaattctgaatcccagcgttataccattgctccatcattctcatggcgtccagacgacaaaaccaattttactttcctgtcctatttccagaatgaaccagaaacgggttattacggttggttgccgaaagaggggaccgttgagccattgcctaatggtaaacgtctaccgactgacttcaatgaaggtgcatcgaataatacatactcccgtaaccagaaaatggtgggatatagttttgaacatggttttaatgacaccttcaccgtgcgtcagaatctgcgtttcagtgaaatgaaaacctcacagaaaagtgtttatggcacagggattgccaacgatggtcatactctaaaccgcgggacagtggtggataatgagcgtctgcaaaactttagcgttgatacccaacttgaaagtaaatttgctacaggtgaagtggagcatactttgctgacaggggtagacttcatgcgtatgcgcaatgatatcaatgccagctttggatctgcaccatcaatcgatctttataacaaatatcatcctgaatactttgcatttggtaacgcagagccataccaaatgaatgaaagcaaacaaacaggtatttatgttcaggatcaggcggaatggaataaatgggtattcactctggggggacgctacgattggtctaagcaagcgaccactgttcgtgaaaactcttatacgccgactgaaggttatattgagcgtaatgatcatcagttcacctggcgcggtggtgtaaattacttattcgataatggtatttcaccttactttagctatagccagtcctttgaaccgagtgctttcgatctgtggagcaacccgcgcgtttcctataagccatcgaaaggtgaacagtatgaagctggcgtaaaatatgttccgaatgatatgccggtcgttgttacgggcgcagtctatcaattgacgaaaacaaataacctgacagcagacccaacaaacccgttagcgcaagtcccagcaggtgagattcgcgctcgtggtgtggagcttgaagcaaaagcagcgttaaatgccaatattaacttgacggcttcttatacctacacggatgcggaatacaccaaagacaccaatctcaaaggtaaaactccagaacaagtaccggagcatatggcatctctctggggggattataccttcaatgaagggccgctttctggtttaacattgggaacaggtggtcgttttattggttccagctatggtgatccggcaaacacttttaaagtgggtagcgcagctgtaatggatgctgttgtaaaatatgatctggcacgctttggtatggcgggatccagccttgctgtgaacgtcaacaatttgctcgatcgtgagtatgttgccagttgcttccagacttatggctgcttctggggcgcagaacgtcaggtcgttgcaaccgcaaccttccgtttctaatttctcttttggggcacggattaccgtgcccatttcacaagttggctgttatgcaggaatacacgaatcattccgataccacttttgcactgcgtaatatctcctttcgtgtgcccgggcgcacgcttttgcatccgctgtcgttaacctttcctgccgggaaagtgaccggtctgatcggtcacaacggttctggtaaatccactctgctcaaaatgcttggccgtcatcagcctccgtcagaaggggagattcttcttgatgcccagccgctggaaagctggagcagcaaagcgtttgcccgcaaagtggcttatttgccgcagcagcttcctccggcagaagggatgaccgtgcgtgaactggtggcgattggtcgttacccgtggcatggcgcgttggggcgctttggggcggcagatcgcgaaaaagtcgaggaagctatctcgctggttggcttaaaaccgctggcgcatcggctggtcgatagtctctctggcggcgaacgtcagcgggcgtggatcgccatgctggtggcgcaggatagccgttgtctgttgctcgacgaaccgacttcggcgctggatatcgcccaccaggttgatgtgctggcgctggtgcaccgtttaagtcaggaacgtggcctgacggtcattgccgtgctgcacgatatcaatatggcggcacgctactgtgattatctggtcgccctgcgcggtggtgaaatgattgctcagggaacgcctgcggaaattatgcgcggcgaaaccctcgaaatgatttatggcatcccgatgggtattttgccgcatccggcgggtgctgcacctgtgagttttgtttattgatgagcggcttacctcttatttcgcgccgtcgactgttaacggcgatggcgctttctccgttgttatggcagatgaataccgcccacgcggcggctattgaccccaatcgtattgtggcgctggagtggttgccggtggaattactgctggcgctcggcatcgtgccttacggcgtggcggataccatcaactatcgcctgtgggtcagcgaaccaccattgccggactcagtgattgacgtcggtttgcgtacagaacctaaccttgaactgctgaccgaaatgaaaccgtcgtttatggtctggtcggcaggatatggcccttcaccagaaatgctggcacgtattgcgccgggtcgcggatttaacttcagtgacggcaaacagccgctggcgatggcgcgtaaatcgctgacggaaatggcagatttacttaacctgcaaagcgcagcagaaacgcatttagcgcactatgaagactttatccgcagcatgaaaccccgctttgtgaagcgtggtgcacgcccgttattgctgacgacgcttatcgatccgcgccatatgttggtttttgggccaaacagcttgttccaggaaattctcgatgagtacggcatcccaaatgcctggcaaggggaaaccaacttctggggcagtaccgccgtcagtatcgatcgtctggcggcgtataaagacgttgatgtgctctgttttgatcacgacaacagcaaagacatggatgcgctaatggcaaccccgctgtggcaggccatgccgtttgtccgcgccggacgctttcagcgcgtacctgcagtctggttttatggtgcgacgctctcggcaatgcactttgtgcgtgttctggataacgccatcggaggtaaagcgtgagtaaacgaattgcgcttttcccggcgttattgctggcgctgctggtgattgtcgctacggtgctcacctggatgaacttctcacagtcgctgccgcgcagtcagtgggcgcaggccgcctggtcgccggatattgacgtcatcgagcagatgatttttcactacagcttgttaccgcgtctggcgatttcgctgctggtgggcgcgggcctggggctggtgggcgtgctgtttcagcaagtgctgcgtaacccgctggcggagccgacgacgcttggcgttgcaacaggcgcgcaactgggaattaccgtcaccacactttgggcgatccccggtgctatggcgagccagtttgccgcgctggtgggcgcttgtgtcgttggcttaatcgtctttggcgtcgcgtgggggaaacggctttcgccggttacgcttattctcgcggggctggtggtgagcctttattgcggggcaattaatcagctactggttatcttccatcacgaccagctgcaaagcatgttcctgtggagcaccggaacgctgacgcaaaccgactggggcggcgttgagcgtttatggccgcagttgctgggcggcgtgatgttgacgttattgctacttcgcccgttaaccctgatggggcttgatgatggcgtggcgcgcaatctcgggctggccttgtcgctcgcgcgtctggcagcgctgtcgctggcgattgtcatcagtgcgctgctggtgaacgctgtggggattatcggctttatcgggttgttcgcgccgctgctggcaaaaatgctgggggcgcggcgtctgctgccacgactgatgctggcgtcgctgattggggcgctgatcctctggctttccgatcaaatcatcctctggctgactcgcgtgtggatggaagtgtccaccggttcggtcactgcgttgatcggtgcgccgctgctactgtggctgttgccgcgtttacgcagcattagcgcgccggatatgaaggtcaacgatcgtgtcgcggctgaacgccaacatgtgctggcgtttgccctcgcgggcggcgtgctgctgttgatggctgtggtggtggcgctgtcgtttggtcgtgatgcgcacggctggacgtgggcgagcggggcgttgcttgaggatttgatgccctggcgctggccgcgaattatggcggcgctgtttgcgggcgtcatgctggcggtggcgggctgtattattcagcggctgaccggaaacccgatggcaagcccggaagtgctggggattagctctggcgcagcgtttggcgtggtgttgatgctgtttctggtgccgggtaatgcctttggctggctgttacctgcaggcagtctcggcgcggcggtgacgctgttgatcattatgatcgccgccggccgcggtggattttccccacaccgcatgttactggcggggatggcgttaagcaccgcgttcaccatgcttttgatgatgttgcaggcaagtggtgacccgcgaatggcgcaagtgctgacctggatttccggttcgacctacaacgcgaccgatgcgcaggtctggcgcacgggaattgtgatggtgattttgctggcgattaccccgctgtgccgccgctggctgaccattttaccgctgggtggtgataccgcccgagccgtaggaatggcgctgacgccgacgcgaattgcgctgctgctgttagcggcttgcctgacggcgaccgcgacgatgactattggaccgttgagttttgttggtttaatggcaccgcatattgcgcggatgatgggctttcgacggacgatgccacacatcgtaatttcggcgctggtgggtggtttactgctggtgttcgctgactggtgtgggcggatggtgctgtttccattccagatcccggcagggctgctgtcgacctttatcggcgcgccatattttatctatttgttgagaaagcagagccgttaatagaatgcctcgcccggtgggcgaggcaaaatcatcacaacttcgcaaacacccgtcgtgcagcatcgatggtgttattgatatcttccatgctgtgcgccacggacataaagcccgcttcaaacgctgacggtgccaggtaaacaccttcgtccagcatcatatggaagaaacgcttaaagcgttccacgtcacaggccatcacatcctgatagcacgtcacggactcggcgtcggtaaagaaaataccgaacatgccgccaacgtggttaacgaccagcggaattccggcttcttctgccgcttccagcagaccttctgccagacgtgttgtcagctcatccagcgtttcgtgaacgcccggctgcgcgacttcattcagacaggcgaaacccgctgccatcgcaattgggttaccggaaagcgtacccgcctgatagaccggacccgtcggggccagcgcatccattacatcacgacgaccaccgaatgcgcctaccggcattccaccgccgatgattttgcccaggcaggtgagatccggttccacaccgtaataatcctgtgcgccagctagcgctacgcggaagccagtcattacttcatcgatgatcagcaatgcgccaaattcgtcgcacagcgcgcgcagacctggcaggaactctggcagcggtggaacgcagttcatattgcctgccaccggctcgacgataatacaggcaatctcttgcgggtattgctcaaacgcggcgcgtacagaagccagatcgttataagtacaggttaaggtatgtttggcgaaatctgccggaacacccggcgagtttggctggcctaacgtgagtgcgccagaaccggctttcaccagcaggcagtcagcgtgaccgtggtaacaaccttcaaatttaatgattttgtcgcgaccggtaaaaccacgggccaggcggatggcgctcatcgtcgcttcagtgccggagttcaccatgcgcaccatatccatggtcgggaccagttcggtcaccagttgcgccattttcacttccatttcggtcggtgcaccaaagcttaaaccacgctcggcggcttcaatcacggcattgcggatagccggatggttatggcccagcaccatcggcccccaggaaccgacataatcgatataggctttgccatcaacatcgtacagataagcgccgtccgctttttcgataaacagtggagtgccgcccacgccagtaaaggcgcgaacaggggagttcacaccgccagggatcagctcgcgcgctgcgctgtaaagattttcagacttactcatggagggttcctgattcgtagaaaaagtgaatggctgctattctatgttattcataacaagttaaatactcgtcaaacatcaggttgcttgtactggtgcaatcctgatttcttagagtataaaagttttgtgcatttgaaacattacgctttgcaaaggattttcatggaacgtgcgagtaaaatgccgtcatcttatttgtatgaccaataagtgatcattggatgaaaactgatactccctctttagaaacaccgcaggccgcgcgcctgcgacgcagacaactgattcgccaacttcttgagcgcgataaaaccccgttagccattttgtttatggcggcagtcgtcggcacgcttgtcgggctggcagcggttgcttttgacaaaggtgtcgcctggttgcagaaccaacgtatgggggcgctggtacatactgctgataattatccgcttctgttaaccgtcgcttttctctgttcggcggtgctggcgatgttcggctactttttggtgcgcaaatacgcgccggaagcaggtggttcggggatcccggaaattgaaggggcgctggaagatcaacgtcccgttcgctggtggcgtgtgttgccggtgaaattctttggcgggctggggacactcggcggaggcatggtgctagggcgcgaaggaccaaccgtgcagatcggcggcaatatcggtcgcatggtgcttgatattttccgcctgaaaggtgatgaagctcgccatacgctgctggcaaccggtgctgctgcggggctggctgcggcctttaacgcgccgctggcgggtattttgtttattatcgaagagatgcgtccgcagtttcgctatacgttaatttcgattaaagcggtatttattggcgtcattatgtcgaccattatgtaccggatttttaatcatgaagttgcgttgattgacgtcggtaaactttctgatgcgccgcttaatacgctgtggctttatctgatcctcggtattatttttggcattttcggccctatttttaataaatgggtgctggggatgcaggatttgctgcaccgtgtgcacggcggcaatattaccaaatggatactgatgggtggtgcgattggcggtctgtgtggattgctggggtttgtggcaccagcaacgtcgggcggcggttttaacctgattcctatcgctaccgcggggaatttcagcatgggaatgctggtgtttatcttcgtcgctcgggtcattaccaccttactctgcttctcttccggcgcgccgggcggtatttttgccccgatgctggcgctgggtactgtgctgggaaccgctttcggaatggttgccgttgagctgtttccgcaatatcacctggaggcggggacgtttgctattgccggaatgggggcattactggcggcatctattcgcgcgccgttaacggggatcattctggttctggagatgaccgataactaccagctcattttgccaatgattattaccggtcttggcgcaacactattagcgcaatttaccggcgggaaaccgctatactcggcgattcttgcgcgcacgctggcaaaacaggaagctgagcaactggcgcgaagcaaggccgcatcagccagcgagaatacttgaacgaaataccagggtattagataatggcgattattattgggttagaatttgcccaattgccgatgtcgtttggagcaaaatatgagtgatgacgtagcactgccgctggagtttaccgacgcagcagccaacaaagttaaaagcctgatcgctgacgaagataacccgaatctgaaattacgcgtgtatatcaccggtggcggttgcagcggcttccagtatggtttcacctttgatgatcaggtgaacgaaggcgatatgaccatcgaaaaacagggcgttggcctggtggttgatccgatgagcctgcaatatctggtcggcggttccgttgattataccgaaggtctggaaggttctcgtttcatcgtgaccaacccgaacgcgaaaagcacctgcggttgcggttcttcctttagtatctaatctgttgttcatgtgccggataaactatccggcacatcttctctcttcaacgcccattctcatccagcgcaaacgtcggtagcttaagatgccaacgaatagccgccagccgaatcaatagcgtcacgaccatgcccatcatactggctgtttccagtggtacggaaaatgtgtaataagccgtagcgtggacaataccgccgataatacaggcagttgcgtagatttctgtacgtaaaatcatggggatttcgcgggccagtacatcacgaatgatcccgccgccaacgccagtaatgacgcccatacaaaccgcgattaacggaccggcttccgcattaaaggctttattcacgccaatgccgacaaacaccgccagaccaacggcgtccagcaccggcaacatccattttggtaagcgtcttggctggcgcaccagcacgatggtcagcatgctggtgaccattgcaacgaccagatcggtgggatctttcacccaaaataccgggccgtgatccagcgccatgtcgcgaattgtcccgccgcctacagcggtaaccacgcccagtaccagaacaccaaaagggtccatacgcaattttccggctaacaaaacgccggagatggcaaataccgctgtgccgactatatccagccaatagacgagcattgttcaatccccactgagcacctgaaaaggtcaggcactaatctacctgtgaaagcgcattacagagctgttgtgcagcgaggataatacgtgggcttgcacgttcaaaccagtcactcgtgagaggaataacgggaattttgagctgttcaccccagtattgtttgattttaggaatttggtccggtccgcctgtaatgacaatcgcctgtggcgagcgtgctaacacctgttcgcggctaacttgcggccagggaacccggctgtctttaaagatgttttctccgccacaaacttcgagtacctggttctgaatcgactcttttccactggtaaatggcggattaatgccgaattgcagaaaaacacgttttttaggtttatcagcatattgcgctttcaattgcgcgtactgatccagcagggattgcgcggcttgttcggccttgtctggttgcggactccagggggccagttgacgtaacgcattggcaatttgttcaatgcttgtcgcatcgacccacatcacttttattcccagcgaagccagctggtcaacctgccgctcggcattacctccacgccaggcaatcaccagatcgggtttcagcgcgacaatgcgttccagattcatcccctgccaggtggaaacctgctcaatcttttgcgcttgtggaggatagtcggaatagctgctgaccccaaccggcgtgatcccggcggcaaaggcaagttcagtgttggcgggagaaagcgtgatgacgcgcggcgcggcgttgagccacagtggcgcaagaaaagacagggcgaccagcgccctgaacagtgacttagccatgtgcaagtttctgcaccagtgactcaaccatcaggctggactgtttagcggcaacagccaggaactcatcgaagctaagatgagactgttgatcggccacgtcggagatggcgcgtacgacaacaaacgggacgttgaaattgtggcagacatgggcgattgccgtcgcttccatctctacagcaatggcctgtgggaagttgtggcggattttcgccagaccaacagaaccgttgatgaaagcgtcgccgctaacaatcaggccacgtacagcgttaagattcagttcggcaatgcaggcctcagcggcagcgatcagtttatcgtcagctttaaagcctgccggacagcctggtaactgaccgtattcataaccaaatgccgtgacatccgcgtcgtgataacgtgcttcgtccgagacaacgatatcgcccactttcaacgttggtgccaggccaccggcagaaccggtgttaataatcacatctggcttgcagtgttccaacagcaaagtggcacccagcgccgcagcgactttaccgatgcccgatttcagaagcgcaacctcggttccattcagttggccggtatagatttcgcaaccgccgagactgatagtttgacgtttttcgattttgtcacgcagcagcgtaacttcttcttccattgcaccaatgatgccgattttcatagatttactcgcgataagcccgatttgaaggcatagtttaccatgcgcttacggggaagcgtatttctcacgcgggagaggacatggcacagattgatttccgaaaaaaaataaactggcatcgtcgttaccgttcaccgcagggcgttaaaaccgaacatgagatcctgcggatcttcgagagcgatcgcgggcgtatcatcaactctccggcaattcgtcgtctgcaacaaaagacgcaggtttttccactggagcgcaatgccgccgtgcgcacgcgtcttacccactcgatggaagtccagcaggtggggcgctacatcgccaaagaaattttaagccgtctgaaagagcttaaattgctggaagcatacggcctggatgaactgaccggaccttttgaaagcattgttgagatgtcatgcctgatgcacgatatcggcaatccgccgtttggtcattttggcgaagcagcgataaatgactggtttcgccaacgtttgcacccggaagatgccgaaagccagcctctgactgacgatcgctgcagcgtggcggcactacgtttacgggacggggaagaaccgcttaacgagctgcggcgcaagattcgtcaggacttatgtcattttgaggggaatgcacaaggcattcgtctggtgcatacattgatgcggatgaatctcacctgggcacaggttggcggtattttaaaatatacccgtccggcgtggtggcgtggcgaaacgcctgagacacatcactatttaatgaaaaagccgggttattatctttctgaagaagcctatattgcccggttgcgtaaagaacttaatttggcgctttacagtcgttttccattaacgtggattatggaagctgccgacgacatctcctattgtgtggcagaccttgaagatgcggtagagaaaagaatatttaccgttgagcagctttatcatcatttgcacgaagcgtggggccagcatgagaaaggttcgctcttttcgctggtggttgaaaatgcctgggaaaaatcacgctcaaatagtttaagccgcagtacggaagatcagttttttatgtatttacgggtaaacaccctaaataaactggtaccctacgcggcacaacgatttattgataatctgcctgcgattttcgccggaacgtttaatcatgcattattggaagatgccagcgaatgcagcgatcttcttaagctatataaaaatgtcgctgtaaaacatgtgtttagccatccagatgtcgagcagcttgaattgcagggctatcgggtcattagcggattattagagatttatcgtcctttattaagcctgtcgttatcagactttactgaactggtagaaaaagaacgggtgaaacgtttccctattgaatcgcgcttattccacaaactctcgacgcgccatcggctggcctatgtcgaggctgtcagtaaattaccgtcagattctcctgagtttccgctatgggaatattattaccgttgccgcctgctgcaggattatatcagcggtatgaccgacctctatgcgtgggatgaataccgacgtctgatggccgtagaacaataaccaggcttttgtaaagacgaacaataaatttttaccttttgcagaaactttagttcggaacttcgcgctataaaacgaatctgaagaacacagcaattttgcgttatctgttaatcgagactgaaatacatgaaaaaaaccacattagcactgagtgcactggctctgagtttaggtttggcgttatctccgctctctgcaacggcggctgagacttcttcagcaacgacagcccagcagatgccaagccttgcaccgatgctcgaaaaggtgatgccttcagtggtcagcattaacgtagaaggtagcacaaccgttaatacgccgcgtatgccgcgtaatttccagcagttcttcggtgatgattctccgttctgccaggaaggttcaccgttccagagctctccgttctgccaggggggccagggcggtaatggcggcggccagcaacagaaattcatggcgctgggttccggcgtcatcattgatgccgataaaggctatgtcgtcaccaacaaccacgttgttgataacgcgacggtgattaaagtccagctgagcgatggtcgtaagttcgacgcgaagatggttggcaaagatccgcgctctgatatcgcgctgattcagatccagaacccgaaaaacctgaccgcaattaagatggcggattctgatgcactgcgcgtgggtgattacaccgtagcgattggtaacccgtttggcctgggagagacggtaacttccgggattgtctctgcgctggggcgtagcggcctgaatgccgaaaactacgaaaacttcatccagaccgatgcagcgatcaaccgtggtaactccggtggtgcgctggttaacctgaacggcgaactgatcggtatcaacaccgcgatcctcgcaccggacggcggcaacatcggtatcggttttgctatcccgagcaacatggtgaaaaacctgacctcgcagatggtggaatacggccaggtgaaacgcggtgagctgggtattatggggactgagctgaattccgaactggcgaaagcgatgaaagttgacgcccagcgcggtgctttcgtaagccaggttctgcctaattcctccgctgcaaaagcgggcattaaagcgggtgatgtgatcacctcactgaacggtaagccaatcagcagctttgccgcactgcgtgctcaggtgggtactatgccggtgggcagcaaactgaccctgggcttgctgcgcgacggtaagcaggtcaacgtgaatctggaactgcagcagagcagccagaatcaggttgattccagctccatcttcaacggcattgaaggcgctgagatgagcaacaaaggcaaagatcagggcgtggtagtgaacaacgtgaaaacgggcactccggctgcgcagatcggcctgaagaaaggtgatgtgattattggcgcgaaccagcaggcagtgaaaaacatcgctgaactgcgtaaagttcttgacagcaaaccgtctgtactggcactgaacattcagcgcggcgacagctccatctacctgttaatgcagtaatctccctcaaccccttcctgaaaacgggaaggggttctccttacaatctgtgaacttcaccacaactccatacatcttcatcatcctttaggcatttgcacaatgccgtacgttacgtacttccttatgctaagccgtgcataacggaggacttatggctggctggcatcttgataccaaaatggcgcaggatatcgtggcacgtaccatgcgcatcatcgataccaatatcaacgtaatggatgcccgtgggcgaattatcggcagcggcgatcgtgagcgtattggtgaattgcacgaaggtgcattgctggtactttcacagggacgagtcgtcgatatcgatgacgcggtggcacgtcatctgcacggtgtgcggcaagggattaatctaccgttacggctggaaggtgaaattgtcggcgtaattggcctgacaggtgaaccagagaatctgcgtaaatatggcgaactggtctgcatgacggctgaaatgatgctggaacagtcgcggttgatgcacttgttggctcaggatagccgtttgcgggaggaactggtgatgaacctgattcaggcagaggagaatactcccgcacttactgaatgggcgcaacggctggggatcgatctcaatcaaccgcgagtggtggctattgttgaggtcgacagcggtcagcttggtgtggacagcgcaatggcggagttacaacaactgcaaaacgcgctgactacgcccgagcgtaataatctggtggcgattgtctcgctaaccgaaatggtggtgttgaaaccggcgttgaactcttttgggcgctgggatgcagaagatcatcgtaagcgagttgaacaactgattacccgcatgaaagagtacggccagctgcgttttcgcgtttcactgggcaactattttaccggtcctggcagtattgcccgatcctatcgtacggcgaaaacgacgatggtggtgggtaaacagcggatgccagaaagtcgctgctatttttatcaggatctgatgttacctgtgttactcgacagtttgcgtggcgactggcaggccaacgaactggcgcgaccgctggcgcggctgaaagcgatggacaataacggcttgctgcgacgaacgctggcggcgtggtttcgtcacaatgtgcaaccgctggcaacgtcaaaggcgttgtttattcatcgtaatactctggagtatcggcttaatcgtatatcggaactgaccgggcttgatttgggtaattttgatgacaggttgctgctgtatgtggcgttgcagctggatgaagagcggtaggttatgcgttaaggtcgaggcggcgctggctcattcccctcagcccgaagggtagaggggaatgtccgagttaaccgtcagttcggcattatttacgcgttagtttttccagatcggcttcaatctcgctgatcttattggttacgactgactccaggtgacgtaagtcgtcgaggatcttacgcttaagatcaacttcgctgcggtcacgctggcagatttgatcaagctcatcaatgatataccgtagattcgggctgatttcctggacttctttataaccctgacccacaccatcagcgacgaccgttttacgctgacgcggatatttaaacttaacgctcttggcgaaaaactcgcctttgtctttctggaaatagattttcagaatatcgttgttggcttcctgccggaggctgtaacgatcaatttcttcaggattggtaatacccagacttttcagattgtcgtacatagcgttacctcaaaatgagtcagtaaattgtgcttattttagcatttggcctggcccgcccggctcgactgtgatcgcagaaagcctttttcttccagacttctatcatggcgtaaaaatcaaaaaattacctgctttattgtggcgatattccatgggatggattaacacatttatcttcgttttgcgaattacatgacagtccgaaacaagatgaaaaagtatttaaaaaaggggggaagaagaatgagtaggacgaattattctgagccagaaagcatacgggcagcatcatgctgcccgtatatgtactcttaatcgatggtacgcagcagttcgttaatgccgactttgccgcgagttttcgcgtcaactttcttaacgataaccgcacagtagaggctgtatttgccatctttcgacggcagattacctgaaacaaccacagaccccgccggaacgcgaccgtagtggatttcgccggtttcacggtcgtaaatacgggtgctctgaccaatgtatacgcccatagagatgacggaaccttcttcgacaatcaccccttcaaccacttcggagcgtgcgccaatgaagcagttatcttcaataatggtcgggttagcctgcagcggctccagcacgccgccgatgcccacgccaccggaaaggtggacgtttttaccaatctgcgcacaagaaccgacggtcgcccaggtatcaaccatcgtgccttcatcaacatatgcgccgatgttgacgtaagacggcatcagcacggtgttacgggcaataaatgcaccctgacgtaccgccgctggtggcacaacgcggaagccttctttctgaaaacgcgcttcgtcgtagtcggcgaatttcatcggcactttatcgaagtagcggctttctgccccttcgatcacctgattatcattaatacggaaagagagcagcaccgcttttttcaaccactgatgcgtcacccactgaccgtcaattttttccgctacacgcagtgcgccggaatccagcagggcgatcacctgatttaccgcttcgcgggttacggtgtctgcattggctggcgtgatctcggcacggcgttcaaaagcggtttcaataatgttctgtaactgctgcattgttaaactcttttcatatcagtaaacacatcaccctttatcgtttggattgagggcctctgtcaaccgctgatgcacttcctgctgcaactcgttattaagtgcacgccggtcagcggtggcaattatgaataaatcttctactcgctcgccaatggttgtaattcgggcaccatgaagcgaaattcccagatcggcaaaaattttcccgactctcgccagcagtcctggctggtcgagcgcgataagctcaaggaacgatttgcggtcggtatgggtcggcaaaaacgttacttcggtttcaacagtaaaatggcgtaatttggcgggttggcgacggggctgcggtggctgccagctactttgcgtcagtacttgctccagaccaaaccgaataacctcatgacgatctgcggacagcgggctgccatcgggttccagcacgataaaggtatccatcgccataccgtcgcgagtggtgaaaatttgtgcgtcgtgaacacttaaattgcggcggtctaattcggcacagacggcggcaaacagataggggcggtccgggctccagataaaaatctcggtgcctccacgcgtagcctgcgggctaagcaataccagcggtttgcttaaatcatgctgtaataaatggcgggcatgccaggccagttgatttgggctatggcggacaaaatagttagcacgacagcgtgaccaaatttggtgcagcgcctcttcgtcgatgttatccatgcgcagtagtgccagtgcctggagttggtgatggcgaacccgttcgcgcatatccggcgtgttttgcattccgcgtcgtagctgcttttcggtggcaaaatagagttcgcgcaacagactttgcttccagctattccacagcgtttcgttggtggcgcaaatgtcagccactgtcaggcataccagatagcgcagacgattttccgtttgaacttcttcggcaaactgcttgatgacttcagggtcctgaatatcgcggcgttgtgctgtcaccgacatcagcaagtgctggcgaaccagccaggcaaccagctgtgtttcgcgtgagttcagcccgtggagttctgcaaaatgcactacatcctgagcaccgagaatggagtggtcgccgccgcgtcctttggcgatatcgtgaaacagcgcggcgatgaaaatcagctcagttgacggcaggcgcggccagacgtccacacacaacggatggcgctggcgcgtttcttcactggcaaaactctccagtttcagcatcacgcggatagtatgttcatccaccgtgtaggcgtggaacagatcaaactgcatctgcccgacgatatgcgaccattgcggcatatacgcgccgagcacgctatggcgatgcattggcaatagcccgcgccgcaccgctccggggtgacgcagaatgctcaaaaacagttttcgtgcttccggaatattacacagcggttgttgcagatggcgacgggcatggcgtaactggcgcagcgtggtggagtaaatgccggtgatcgcactgttgcgcaccatggtgtagaacatacgcaagatggcttccggctggcgcataaatagtgtttcatcacgcaggtcgattagcgtaccgcgtagctgaaactcatcgtcgattggacgtggtttttcgtcggcgggaagggcgaggatggcttcatcgaacagttgcagcagcatctggttgagttcactgacgcggcgtgtaacgcggaagtaatccttcatcatccgctcgaccggttcgttgccttcaccactgtaattcagacgctgagcgacgctaagttggcgatcgaataacagacgattatcgtaacggctgacgaccagatgcagggcaaagcgaatacgccacagtatatgcagacattcgtttaattccgcccgctccgctgaggttaagaagccaaacccgaccatttcatccagcgatgttgcgccaaaatgacggcgggccacccattgcagagtgtgaatatcgcgcaagccgccagggctacttttgatgtctggttcaaggttgtagctggtgccatggtaacgctgatggcgctggttctgttcttcaactttcgccgcgtagaacttgtcggaaggccagaatccttcgctaaaaatatgtttttgcagttcgaggaagagcgcaacatcgccaattaataagcgggattcgattaaattggtggcgacggttaaatccgataacccttccagcatgcactcttcaagcgtgcgcacactatgaccgacttccagctttacatcccagagcagcgttaacagctcgcccactttttgcgcctgatcgtccgggagctttttacggcttaaaatcagtaaatcgatgtcagaaagtggatgcagctcgccacgaccgtagccaccgacggcgaccaatgccaggtcggcaatctggctgaatcccgcttcaatccataatcgttgcaggagctggtcgataaactcggtgcgcgcctcaatcaactgttctgcagagatcccattgtcaaaggcatcacccagccaacgctggaaagtatcgatatgggcttttatcccaccgacggttaattcatcacggggccagacgcatggattttgcggttgaccgggcagggtggggagagcggtgtttgcgtactgttctggaagggtattcattgtgcgccacccataagattaaattatcgcattaaaaaagccggcattcgccggcttcatcttattcgtcgtgcgagattatcgccgggatggtgtcatccttgcgtagcgtcaaaatttcgcagccgttatcagtcaccacaatagtatgctcatattgtgcagacaagctgcgatctttggtttttaccgtccagccatctttcatggtgcggatctcttttttacccgcgttgaccattggctcaatggtgaacgtcatccccggtttcagcacgacgttggtttcacgggagtcatagtgcagcacctgcggttcttcatggaagccgcgaccaataccgtgtccacaatattcacgaacgacggagaagccttctgcttcgacaaacttctgaatcgccgcaccgatttcgcgcaggttaatgcctggtttgaccatgcgcagcgccaggtacaggctttcttgcgtgatgcggcacagacgttcgcccatgatggtcggcttaccgacgataaacattttcgaggtatcgccgtggaaaccatctttgattacggtgacatcaatgttaacgatatcgccatctttcagcagcttagcatcgtccgggataccgtggcacaccacttcattaatagagatgcaaacggatttcggatagccgtgatagccgaggcaggcagaaaccgcgtgttgttcattaacaatgtaatcattacagatgcgatccagctcgccggtgctgacgcccggtttaacatacggttcgatcatctccagcacttcggcagccagtcggccagcgacgcgcattttttcgatatcttctggggtcttgattgagatagccattaattctgtccatcagcgtcggtgataccgacaatatatatgtaagtgccgtcaatggtatcacacccgggcaaattgagaatcattctgaatttcgccaaacgtgccactgaaggttttctataatagaaaattcgacatctgatgctgtacacagcgccaacaattattggtgtccatgacgtatttgtggtataaagcgcgccggacttccgatccatttcgtatacacagactggacggaagcgacaatctcactttgtgtaacaacacacacgtatcggcacatattccggggtgccctttggggtcggtaatatgggatacgtggaggcataaccccaacttttatatagaggttttaatcatggcaactgtttccatgcgcgacatgctcaaggctggtgttcacttcggtcaccagacccgttactggaacccgaaaatgaagccgttcatcttcggtgcgcgtaacaaagttcacatcatcaaccttgagaaaactgtaccgatgttcaacgaagctctggctgaactgaacaagattgcttctcgcaaaggtaaaatccttttcgttggtactaaacgcgctgcaagcgaagcggtgaaagacgctgctctgagctgcgaccagttcttcgtgaaccatcgctggctgggcggtatgctgactaactggaaaaccgttcgtcagtccatcaaacgtctgaaagacctggaaactcagtctcaggacggtactttcgaaaagctgaccaagaaagaagcgctgatgcgcactcgtgagctggagaaactggaaaacagcctgggcggtatcaaagacatgggcggtctgccggacgctctgtttgtaatcgatgctgaccacgaacacattgctatcaaagaagcaaacaacctgggtattccggtatttgctatcgttgataccaactctgatccggacggtgttgacttcgttatcccgggtaacgacgacgcaatccgtgctgtgaccctgtacctgggcgctgttgctgcaaccgtacgtgaaggccgttctcaggatctggcttcccaggcggaagaaagcttcgtagaagctgagtaataaggcttgataactcccccaaaatagttcgagttgcagaaaggcggcaagctcgagaattcccgggagcttacatcagtaagtgaccgggatgagcgagcgaagataacgcatctgcggcgcgaaatatgaagggggagagcccttatagaccaggtagtacacgtttggttagggggcctgcatatggccccctttttcacttttatatctgtgcggtttaatgccgggcagatcacatctccgaggattttagaatggctgaaattaccgcatccctggtaaaagagctgcgtgagcgtactggcgcaggcatgatggattgcaaaaaagcactgactgaagctaacggcgacatcgagctggcaatcgaaaacatgcgtaagtccggtgctattaaagcagcgaaaaaagcaggcaacgttgctgctgacggcgtgatcaaaaccaaaatcgacggcaactacggcatcattctggaagttaactgccagactgacttcgttgcaaaagacgctggtttccaggcgttcgcagacaaagttctggacgcagctgttgctggcaaaatcactgacgttgaagttctaaaagcacagttcgaagaagaacgtgttgcgctggtagcgaaaattggtgaaaacatcaacattcgccgcgttgctgcgctggaaggcgacgttctgggttcttatcagcacggtgcgcgtatcggcgttctggttgctgctaaaggcgctgacgaagagctggttaaacacatcgctatgcacgttgctgcaagcaagccagaattcatcaaaccagaagacgtatccgctgaagtggtagaaaaagaataccaggtacagctggatatcgcgatgcagtctggtaagccgaaagaaatcgcagagaaaatggttgaaggccgcatgaagaaattcaccggcgaagtttctctgaccggtcagccgttcgttatggaaccaagcaaaactgttggtcagctgctgaaagagcataacgctgaagtgactggcttcatccgcttcgaagtgggtgaaggcatcgagaaagttgagactgactttgcggcagaagttgctgcgatgtccaagcagtcttaattatcaaaaaggagccgcctgagggcggcttctttttgtgcccatcttgtaaattcagctaacccttgtggggctgcgctgaaaagcgacgtacaatgtcgctagtattaattcatttcaatcgttgacagtctcaggaaagaaacatggctaccaatgcaaaacccgtctataaacgcattctgcttaagttgagtggcgaagctctgcagggcactgaaggcttcggtattgatgcaagcatactggatcgtatggctcaggaaatcaaagaactggttgaactgggtattcaggttggtgtggtgattggtgggggtaacctgttccgtggcgctggtctggcgaaagcgggtatgaaccgcgttgtgggcgaccacatggggatgctggcgaccgtaatgaacggcctggcaatgcgtgatgcactgcaccgcgcctatgtgaacgctcgtctgatgtccgctattccattgaatggcgtgtgcgacagctacagctgggcagaagctatcagcctgttgcgcaacaaccgtgtggtgatcctctccgccggtacaggtaacccgttctttaccaccgactcagcagcttgcctgcgtggtatcgaaattgaagccgatgtggtgctgaaagcaaccaaagttgacggcgtgtttaccgctgatccggcgaaagatccaaccgcaaccatgtacgagcaactgacttacagcgaagtgctggaaaaagagctgaaagtcatggacctggcggccttcacgctggctcgtgaccataaattaccgattcgtgttttcaacatgaacaaaccgggtgcgctgcgccgtgtggtaatgggtgaaaaagaagggactttaatcacggaataattcccgtgatggataaataagggtaagattccgcgtaagtatcgcgggggcgttagtctggttataaggcgttattgttgcaggcagtttggtcacggccagcgcgcagcaaccggagcgtacaaaagtacgtgaggatggcgagcactgcccggggccaaaatggcaaataaaatagcctaataatccagacgattacccgtaatatgtttaatcagggctatacttagcacacttccactgtgtgtgactgtctggtctgactgagacaagttttcaaggattcgtaacgtgattagcgatatcagaaaagatgctgaagtacgcatggacaaatgcgtagaagcgttcaaaacccaaatcagcaaaatacgcacgggtcgtgcttctcccagcctgctggatggcattgtcgtggaatattacggcacgccgacgccgctgcgtcagctggcaagcgtaacggtagaagattcccgtacactgaaaatcaacgtgtttgatcgttcaatgtctccggccgttgaaaaagcgattatggcgtccgatcttggcctgaacccgaactctgcgggtagcgacatccgtgttccgctgccgccgctgacggaagaacgtcgtaaagatctgaccaaaatcgttcgtggtgaagcagaacaagcgcgtgttgcagtacgtaacgtgcgtcgtgacgcgaacgacaaagtgaaagcactgttgaaagataaagagatcagcgaagacgacgatcgccgttctcaggacgatgtacagaaactgactgatgctgcaatcaagaaaattgaagcggcgctggcagacaaagaagcagaactgatgcagttctgatttcttgaacgacaaaaacgccgctcagtagatccttgcggatcggctggcggcgttttgctttttattctgtctcaactctggatgtttcatgaagcaactcaccattctgggctcgaccggctcgattggttgcagcacgctggacgtggtgcgccataatcccgaacacttccgcgtagttgcgctggtggcaggcaaaaatgtcactcgcatggtagaacagtgcctggaattctctccccgctatgccgtaatggacgatgaagcgagtgcgaaacttcttaaaacgatgctacagcaacagggtagccgcaccgaagtcttaagtgggcaacaagccgcttgcgatatggcagcgcttgaggatgttgatcaggtgatggcagccattgttggcgctgctgggctgttacctacgcttgctgcgatccgcgcgggtaaaaccattttgctggccaataaagaatcactggttacctgcggacgtctgtttatggacgccgtaaagcagagcaaagcgcaattgttaccggtcgatagcgaacataacgccatttttcagagtttaccgcaacctatccagcataatctgggatacgctgaccttgagcaaaatggcgtggtgtccattttacttaccgggtctggtggccctttccgtgagacgccattgcgcgatttggcaacaatgacgccggatcaagcctgccgtcatccgaactggtcgatggggcgtaaaatttctgtcgattcggctaccatgatgaacaaaggtctggaatacattgaagcgcgttggctgtttaacgccagcgccagccagatggaagtgctgattcacccgcagtcagtgattcactcaatggtgcgctatcaggacggcagtgttctggcgcagctgggggaaccggatatgcgtacgccaattgcccacaccatggcatggccgaatcgcgtgaactctggcgtgaagccgctcgatttttgcaaactaagtgcgttgacatttgccgcaccggattatgatcgttatccatgcctgaaactggcgatggaggcgttcgaacaaggtcaggcagcgacgacagcattgaatgccgcaaacgaaatcaccgttgctgcttttcttgcgcaacaaatccgctttacggatatcgctgcgttgaatttatccgtactggaaaaaatggatatgcgcgaaccacaatgtgtggacgatgtgttatctgttgatgcgaacgcgcgtgaagtcgccagaaaagaggtgatgcgtctcgcaagctgaggataatccggctacagagagtcgcgctatttgttagcgtagggcttcagtgatatagtctgcgccatctgatcgtaagtagttggctttataaggtcaggtatgccgtggttttacacggcttttttttgtataggcttcagtattcctgagtaccgtaaaccctgtcagggaataaaaatgcgtgatgttgtctgctactcaaccacttagcgaaaaattgccagcgcatggctgccgtcatgttgcgatcattatggacggcaatggtcgctgggcaaaaaagcaagggaagattcgtgcctttgggcataaagccggggcaaaatccgtccgccgggctgtctcttttgcggccaacaacggtattgaggcgttaacgctgtatgcctttagtagtgaaaactggaaccgaccagcgcaggaagtcagtgcgttaatggaactgtttgtgtgggcgctcgatagcgaagtaaaaagtctgcaccgacataacgtgcgtctgcgtattattggcgataccagtcgctttaactcgcgtttgcaagaacgtattcgtaaatctgaagcgctaacagccgggaataccggtctgacgctgaatattgcggcgaactacggtggacgttgggatatagtccagggagtcaggcaactggctgaaaaggtgcagcaaggaaacctgcaaccagatcagatagatgaagagatgctaaaccagcatgtctgtatgcatgaactggcccctgtagatttagtaattaggactgggggggagcatcgcattagtaactttttgctttggcaaattgcctatgccgaactttactttacagatgttctctggcccgatttcgatgaacaagactttgaaggggcgttaaatgcctttgctaatcgagagcgtcgtttcggcggcaccgagcccggtgatgaaacagcctgatgggggtcgcttttgctgaagtatcgcctgatatctgcttttgtgttaatacccgtcgtcatcgcggcgttgtttctgttgccgccggtggggttcgccatcgtaacgctggtggtctgcatgctggcagcgtgggaatggggacagcttagcggttttaccactcgttcgcagcgagtatggttggcggtgttatgcgggttattgttggcgctgatgctttttctgttgccggaatatcaccgaaatattcatcaaccgctggttgaaatctcactttgggcttcgctgggttggtggattgtcgcgctattgctggtgctgttttacccaggttccgcagcaatctggcgtaactctaaaacattgcgccttatttttggcgtgctaaccattgttcccttcttctggggcatgctggcgttacgggcctggcactatgacgagaatcattacagtggcgcaatatggctgctctatgtcatgatcctggtatggggcgctgactccggcgcatatatgtttggcaaattgtttggtaaacataagctggcaccgaaggtttctccgggtaaaacctggcaaggctttataggtggactagcgaccgcagcggtaatctcatggggttatggcatgtgggcgaatctcgacgtcgctcccgtcaccttactcatttgctctattgtcgcagcgttagcctcagtgctcggcgatctgaccgagagtatgtttaagcgtgaagcaggaattaaggacagcggtcatttaattccaggacacggtggtattttagatcgtattgatagcctgacggctgcggtaccggtctttgcttgcttgttgttactggtattcaggacgctttaacggaaggtaatatgctgagttttctctgggatttggcttcgttcatcgttgcactgggtgtacttatcaccgtgcatgaatttggtcatttctgggttgcccggcgttgtggtgttcgcgttgagcgtttctcaatagggtttggtaaggcgctctggcggcgaactgataagctcggcaccgaatatgttatcgccctgatcccgctgggcggttatgtcaaaatgctggatgagcgcgcagaaccggtcgttccggaactccgccaccatgccttcaataataaatctgttggccaacgagcggcgattattgccgcaggtccggttgcaaacttcatttttgctatcttagcctactggctggtttttattattggtgtgcctggcgtacgtccggtggttggtgaaatagcagccaattcgatagctgcggaagcacaaattgcaccaggtacggaactaaaagccgtagatggtatcgaaacgcctgattgggatgccgtgcgtttgcagttggtcgataaaattggcgatgaaagcaccaccattacagtagcgccatttggcagcgaccaacggcgggatgtaaagctcgatttacgtcactgggcgtttgagcctgataaagaagatccggtatcttcgctggggattcgtcctcgtgggccgcaaattgaacctgtactggaaaatgtgcagccaaactcggcggcaagcaaggcaggtttgcaagcaggcgacaggatcgttaaagtcgatggtcagcccttaacgcagtgggtgacctttgtgatgcttgtccgggataacccgggtaaatccttagcgttagaaatcgaaaggcaggggagtcccttgtctttgacattaatcccggagagtaaaccgggtaatggtaaagcgattggttttgtcggtattgagccgaaagtcattcctttgccagatgagtataaagttgtacgccagtatgggccgttcaacgccatcgtcgaagccacggacaaaacgtggcagctgatgaagctgacggtcagtatgctgggaaaattgatcaccggtgatgtgaaactgaacaacctcagtgggccgatctctatcgccaagggggctgggatgacagcggaactcggggtagtttattacctgccgtttcttgcgcttattagcgtgaacttagggataattaacctgtttccgttgcccgtacttgacggggggcatctgctgttccttgcgatcgaaaagatcaagggcggaccggtatccgagcgggttcaagacttttgttatcgcattggctcgattctgctggtgctgttaatggggcttgcacttttcaatgatttctctcggttatgagagttagttaggaagaacgcataataacgatggcgatgaaaaagttgctcatagcgtcgctgctgtttagcagcgccaccgtatacggtgctgaagggttcgtagtgaaagatattcatttcgaaggccttcagcgtgtcgccgttggtgcggccctcctcagtatgccggtgcgcacaggcgacacggttaatgatgaagatatcagtaataccattcgcgctctgtttgctaccggcaactttgaggatgttcgcgtccttcgtgatggtgatacccttctggttcaggtaaaagaacgtccgaccattgccagcattactttctccggtaacaaatcggtgaaagatgacatgctgaagcaaaacctcgaggcttctggtgtgcgtgtgggcgaatccctcgatcgcaccaccattgccgatatcgagaaaggtctggaagacttctactacagcgtcggtaaatatagcgccagcgtaaaagctgtcgtgaccccgctgccgcgcaaccgtgttgacctaaaactggtgttccaggaaggtgtgtcagctgaaatccagcaaattaacattgttggtaaccatgctttcaccaccgacgaactgatctctcatttccaactgcgtgacgaagtgccgtggtggaacgtggtaggcgatcgtaaataccagaaacagaaactggcgggcgaccttgaaaccctgcgcagctactatctggatcgcggttatgcccgtttcaacatcgactctacccaggtcagtctgacgccagataaaaaaggtatttacgtcacggtgaacatcaccgaaggcgatcagtacaagctttctggcgttgaagtgagcggcaaccttgccgggcactccgctgaaattgagcagctgactaagatcgagccgggtgagctgtataacggcaccaaagtgaccaagatggaagatgacatcaaaaagcttctcggtcgctatggttatgcctatccgcgcgtacagtcgatgcctgaaattaacgatgccgacaaaaccgttaaattacgcgtgaacgttgatgcgggtaaccgtttctacgtgcgtaagatccgttttgaaggtaacgatacctcgaaagatgccgtcctgcgtcgcgaaatgcgtcagatggaaggtgcatggctgggaagcgatctggtcgatcagggtaaggagcgtctgaatcgtctgggcttctttgaaactgtcgataccgatacccaacgtgttccgggtagcccggaccaggtagatgtcgtctacaaggtaaaagagcgcaacaccggtagcttcaactttggtattggttacggtactgaaagtggcgtgagcttccaggctggtgtgcagcaggataactggttaggtacaggttatgctgttggtatcaacgggaccaaaaacgattaccagacctatgctgaactgtcggtaaccaacccgtacttcactgtagatggtgtaagcctcggtggtcgtctcttctataatgacttccaggcagatgacgccgacctgtccgactataccaacaagagttatggtacagacgtgacgttgggcttcccgatcaacgaatataactcgctgcgtgcaggtctgggttatgtacataactccctgtccaacatgcagcctcaggttgcgatgtggcgttatctgtactctatgggtgaacatccgagcacctctgatcaggataatagcttcaaaacggacgacttcacgttcaactatggttggacctataacaagcttgaccgtggttacttcccgacagatggttcacgtgtcaacctgaccggtaaagtgaccattcctggatcggataacgaatactacaaagtgacgttagacacggcgacttatgtgccgatcgatgacgatcacaaatgggttgttctggggcgtacccgctggggttatggtgatggtttaggcggcaaagagatgccgttctacgagaacttctatgccggtggttccagcaccgtgcgtggcttccagtccaatacaattggtccgaaagcagtttacttcccgcatcaggccagtaattatgatccggactatgattacgaatgtgcgactcaggacggcgcgaaagacctgtgtaaatcggatgatgctgtaggcggtaacgccatggcggttgccagcctcgagttcatcaccccgacgccgtttattagcgataagtatgctaactcggttcgtacttccttcttctgggatatgggtaccgtttgggatacaaactgggattccagccaatattctggatatccggactatagtgatccaagcaatatccgtatgtctgcgggtatcgcattacaatggatgtccccattggggccgttggtgttctcctacgcccagccgttcaaaaagtacgatggagacaaggcagaacagttccagtttaacatcggtaaaacctggtaagtgttctccacaaaggaatgtagtggtagtgtagcgatgactttaggcgatcaatataagatcgccgggccacgcaaagaactgcaccctccggtgcaaatgggatggtaaggagtttattgtgaaaaagtggttattagctgcaggtctcggtttagcactggcaacttctgctcaggcggctgacaaaattgcaatcgtcaacatgggcagcctgttccagcaggtagcgcagaaaaccggtgtttctaacacgctggaaaatgagttcaaaggccgtgccagcgaactgcagcgtatggaaaccgatctgcaggctaaaatgaaaaagctgcagtccatgaaagcgggcagcgatcgcactaagctggaaaaagacgtgatggctcagcgccagacttttgctcagaaagcgcaggcttttgagcaggatcgcgcacgtcgttccaacgaagaacgcggcaaactggttactcgtatccagactgctgtgaaatccgttgccaacagccaggatatcgatctggttgttgatgcaaacgccgttgcttacaacagcagcgatgtaaaagacatcactgccgacgtactgaaacaggttaaataagtaatgccttcaattcgactggctgatttagcgcagcagttggatgcagaactacacggtgatggcgatatcgtcatcaccggcgttgcgtccatgcaatctgcacaaacaggtcacattacgttcatggttaacccaaaataccgtgagcatttaggcttgtgccaggcgtccgcggttgtcatgacccaggacgatcttcctttcgcgaaaagtgccgcgctggtagtgaagaatccctacctgacttacgcgcgcatggcgcaaattttagataccacgccgcagcccgcgcagaacattgcacccagtgcggtgatcgacgcgacggcgaagctgggtaacaacgtatcgattggcgctaacgcggtgattgagtccggcgttgaactgggcgataacgtgattatcggtgccggttgcttcgtaggtaaaaacagcaaaatcggtgcaggttcgcgtctctgggcgaacgtaaccatttaccatgagatccagatcggtcagaattgcctgatccagtccggaacagtggtaggcgcagacggctttggttatgccaacgatcgtggtaactgggtgaagatcccacagattggtcgcgtaattattggcgatcgcgtggagatcggtgcctgcacaaccatcgatcgcggcgcgctggatgacactattattggcaatggcgtgatcattgataaccagtgccagattgcacataacgtcgtgattggcgacaatacggcggttgccggtggcgtcattatggcgggcagcctgaaaattggtcgttactgcatgatcggcggagccagcgtaatcaacgggcatatggaaatatgcgacaaagtgacggttacgggcatgggtatggtgatgcgtcccatcactgaaccaggcgtctattcctcaggcattccgctgcaacccaacaaagtctggcgcaaaaccgctgcactggtgatgaacattgatgacatgagcaagcgtctgaaatcgcttgagcgcaaggttaatcaacaagactaacgttccatcttttgttcgccaaactttacggcctgtctcattcttacgattgcggcaggccgtgttattattgtcgtttcttatattttgacaggaagagtatcttgactactaacactcatactctgcagattgaagagattttagaacttctgccgcaccgtttccctttcttactggtggatcgcgtgctggattttgaagaaggtcgttttctgcgcgcagtaaaaaatgtctctgtcaatgagtcattcttccagggccatttccctggaaaaccgattttcccgggtgtgctgattctggaagcaatggcacaggcaacaggtattctggcgtttaaaagcgtaggaaaactggaaccgggtgagctgtactatttcgctggtattgacgaagcgcgcttcaagcgcccggtcgtgcctggcgatcaaatgatcatggaagtcactttcgaaaaaacgcgccgcggcctgacccgttttaaaggggttgctctggtcgacggtaaagtagtttgcgaagcaacgatgatgtgtgctcgtagccgggaggcctgatacgtgattgataaatccgcctttgtgcatccaaccgccattgtggaagagggcgcgtcgattggcgcgaacgcacacattggtcctttttgtatcgttggaccccatgtcgaaattggtgagggtaccgtactgaaatctcacgttgtcgtgaatggccatactaaaattggccgcgataatgagatttatcagttcgcctccatcggtgaagttaaccaggatctgaaatatgctggcgaaccgacccgtgtggaaatcggcgatcgtaaccgcattcgcgaaagcgtcaccattcatcgtggcacagtccagggcggtggattgacgaaggtgggcagcgacaacttactgatgatcaacgcgcacattgcgcacgattgtacggtaggtaaccgctgtattctcgccaacaacgcaacgctggcgggtcacgtatcggtagacgacttcgcgatcatcggcggcatgaccgcagtccatcagttctgcatcattggtgcgcatgtgatggttggcggttgctccggtgtggcgcaggacgtccctccttatgtcattgcgcagggtaaccacgcaacgccgttcggtgtcaatatcgaagggctgaagcgccgcggattcagccgcgaggcgattaccgctatccgcaatgcgtataagctgatttatcgcagcggtaaaacgctcgatgaagtgaaaccggaaattgctgaactggcggaaacatatccggaagtgaaagcctttaccgatttctttgcacgctcaacgcgcggtctgattcgttaatgactgaacagcgtccattaacgattgccctggtcgccggagaaacctccggcgatatcctgggggccggtttaatccgcgctctgaaagaacatgtgcccaacgcccgctttgttggtgttgccgggccacgaatgcaggctgaaggctgcgaagcctggtacgaaatggaagaactggcggtgatgggcattgttgaagtgctcggtcgtctgcgtcgcttactgcatattcgtgccgatctgacaaagcgttttggcgaactgaagccagatgtttttgttggtattgatgcgcctgacttcaatattactcttgaaggtaacctcaaaaagcagggtatcaaaaccattcattacgtcagtccgtcagtctgggcgtggcgacagaaacgtgttttcaaaataggcagagccaccgatctggtgctcgcatttctgcctttcgaaaaagcgttttatgacaaatacaacgtaccgtgccgctttatcggtcataccatggctgatgccatgccattagatccagataaaaatgccgcccgtgatgtgctggggatccctcacgatgcccactgcctggcgttgctaccggggagccgtggtgcagaagttgaaatgcttagtgccgatttcctgaaaacggcccagcttttgcgccagacatatccggatctcgaaatcgtggtgccactggtgaatgccaaacgccgcgagcagtttgaacgcatcaaagctgaagtcgcgccagacctttcagttcatttgctggatgggatgggccgtgaggcgatggtcgccagcgatgcggcgctactggcgtcgggtacggcagccctggagtgtatgctggcgaaatgcccgatggtggtgggatatcgcatgaagccttttaccttctggttggcgaagcggctggtgaaaactgattatgtctcgctgccaaatctgctggcgggcagagagttagtcaaagaattattgcaggaagagtgtgagccgcaaaaactggctgcggcgctgttaccgctgttggcgaacgggaaaaccagccacgcgatgcacgataccttccgtgaactgcatcagcagatccgctgcaatgccgatgagcaggcggcacaagccgttctggagttagcacaatgatcgaatttgtttatccgcacacgcagctggttgcgggtgtggatgaagtcggacgcgggccgttagttggcgcggtcgtcaccgctgcggtgatccttgacccggcgcgcccgattgccgggctgaatgattccaaaaagctgagcgaaaaacgccgtctggcgctctatgaagagatcaaagagaaagcgttgagctggagtctgggccgcgcggaaccccacgaaatcgacgagctgaacattcttcatgcgaccatgctggcgatgcagcgtgccgtcgctgggctgcatattgcgccggaatatgtgttgattgatggtaaccgctgcccgaaattaccgatgcctgcgatggctgtggtgaaaggcgatagccgcgtaccggaaatcagtgccgcgtctatcctggcgaaagtgacgcgtgacgccgaaatggcggcgctggatattgttttcccgcaatatggttttgcccaacacaaagggtacccaaccgcttttcatctggaaaaactggctgaacacggcgcgaccgaacaccatcggcgcagctttgggcctgtcaaacgcgcactgggacttgcgtcctgattcttgtgtcgagattaagtaaaccggaatctgaagatgtctgaaccacgtttcgtacacctgcgggtgcacagcgactactcgatgatcgatggcctggccaaaaccgcaccgttggtaaaaaaggcggcggcgttgggtatgccagcactggcgatcaccgatttcaccaacctttgtggtctggtgaagttctacggagcgggacatggcgcagggattaagcctatcgtcggggcagattttaacgtccagtgcgacctgctgggtgatgagttaacccacctgacggtactggcggcgaacaataccggctatcagaatctgacgttgctgatctcaaaagcgtatcagcgcgggtacggtgccgccgggccgatcatcgatcgcgactggcttatcgaattaaacgaagggttgatccttctttccggcggacgcatgggcgacgtcggacgcagtcttttgcgtggtaacagcgcgctggtagatgagtgtgtcgcgttttatgaagaacacttcccggatcgctattttctcgagctgatccgcaccggcaggccggatgaagaaagctatctgcacgcggcggtggaactggcggaagcgcgcggtttgcccgtcgtggcgaccaacgacgtgcgctttatcgacagcagcgactttgacgcacacgaaatccgcgtcgcgatccacgacggctttaccctcgacgatcctaaacgcccgcgtaactattcgccgcagcaatatatgcgtagcgaagaggagatgtgtgagctgtttgccgacatccccgaagcccttgccaacaccgttgagatcgccaaacgctgtaacgtaaccgtgcgtcttggtgaatacttcctgccgcagttcccgaccggggacatgagcaccgaagattatctggtcaagcgtgcaaaagagggcctggaagagcgtctggcctttttattccctgacgaggaagaacgtgttaagcgccgcccggaatatgacgaacgtctggagactgaacttcaggttatcaaccagatgggcttcccgggctacttcctcatcgttatggaatttatccagtggtcgaaagataacggcgtaccggtagggccaggccgtggctccggtgcgggttcactggtggcctacgcgctgaaaatcaccgacctcgatccgctggaatttgacctgctgttcgaacgtttccttaacccggaacgtgtctccatgcctgacttcgacgttgacttctgtatggagaaacgcgatcaggttatcgagcacgtagcggacatgtacggtcgtgatgcggtatcgcagatcatcaccttcggtacaatggcggcgaaagcggtgatccgcgacgtaggccgcgtgctggggcatccgtacggctttgtcgatcgtatctcgaaactgatcccgcccgatccggggatgacgctggcgaaagcgtttgaagccgagccgcagctgccggaaatctacgaagcggatgaagaagttaaggcgctgatcgacatggcgcgcaaactggaaggggtcacccgtaacgccggtaagcacgccggtggggtggttatcgcgccgaccaaaattaccgattttgcgccgctttactgcgatgaagagggcaaacatccggtcacccagtttgataaaagcgacgttgaatacgccggactggtgaagttcgacttccttggtttgcgtacgctcaccatcatcaactgggcgctggagatgatcaacaagcggcgggcgaagaatggcgagccgccgctggatatcgccgcgatcccgctggatgacaagaaaagcttcgacatgctgcaacgctcggaaaccacggcggtattccagcttgaatcgcgcggcatgaaggacctgatcaagcgtctgcaacctgactgcttcgaagatatgatcgcactggtggcgctgttccgcccaggtccgttgcaatcagggatggtggataactttatcgaccgtaaacatggtcgcgaagaaatctcctatccggacgtacagtggcagcatgaaagcctgaaaccggtactggagccaacctacggcatcatcctgtatcaggaacaggtcatgcagattgcgcaggtgctttctggttataccctcggtggcgcggatatgctgcgtcgtgcgatgggtaagaaaaagccggaagagatggctaagcagcgttctgtatttgctgaaggtgcagaaaagaacggaatcaacgccgaactggcgatgaaaatcttcgacctggtggagaaattcgcgggttacggatttaacaaatcgcactctgcggcctatgctttggtgtcatatcaaacgttatggctgaaagcgcactatcctgcggagtttatggcggcggtaatgaccgccgatatggacaacaccgagaaggtggtgggcctggtggatgagtgctggcggatggggctgaaaatcctgccaccagatataaactccggtctttaccatttccacgtcaacgacgacggcgaaatcgtgtatggtattggcgccatcaaaggggtaggtgaaggtccgattgaggccatcatcgaagcccgtaataaaggcggctacttccgcgaactgtttgatctttgcgcccgtaccgacaccaaaaagttaaaccggcgggtgctggaaaaactgatcatgtccggggcgtttgaccgtcttggaccacaccgcgcggcactgatgaactcgctgggcgatgcgttaaaagcggcagatcaacacgcgaaagcggaagctatcggtcaggccgatatgttcggcgtgctggccgaagagccggaacaaattgaacaatcctacgccagctgccaaccgtggccggagcaggtggtattagatggggaacgtgaaacgttaggcctgtacctgaccggacaccctatcaaccagtatttaaaagagattgagcgttatgtcggaggcgtaaggctgaaagacatgcacccgacagaacgtggtaaagtcatcacggctgcggggctcgttgttgccgcgcgggttatggtcaccaagcgcggcaatcgtatcggtatctgcacgctggatgaccgttccgggcggctggaagtgatgttgtttactgacgccctggataaataccagcaattgctggaaaaagaccgcatacttatcgtcagcggacaggtcagctttgatgacttcagcggtgggcttaaaatgaccgctcgcgaagtgatggatattgacgaagcccgggaaaaatatgctcgcgggcttgctatctcgctgacggacaggcaaattgatgaccagcttttaaaccgactccgtcagtctctggaaccccaccgctctgggacaattccagtacatctctactatcagagggcggatgcacgcgcgcggttgcgttttggcgcgacgtggcgtgtctctccgagcgatcgtttattaaacgatctccgtggcctcattggttcggagcaggtggaactggagtttgactaatacaggaatactatgagtctgaatttccttgattttgaacagccgattgcagagctggaagcgaaaatcgattctctgactgcggttagccgtcaggatgagaaactggatattaacatcgatgaagaagtgcatcgtctgcgtgaaaaaagcgtagaactgacacgtaaaatcttcgccgatctcggtgcatggcagattgcgcaactggcacgccatccacagcgtccttataccctggattacgttcgcctggcatttgatgaatttgacgaactggctggcgaccgcgcgtatgcagacgataaagctatcgtcggtggtatcgcccgtcttgacggtcgtccggtgatgatcattggtcatcaaaaaggtcgtgaaaccaaagaaaaaattcgccgtaactttggtatgccagcgccagaaggttaccgcaaagcactgcgtctgatgcaaatggctgaacgctttaagatgcctatcatcacctttatcgacaccccgggggcttatcctggcgtgggcgcagaagagcgtggtcagtctgaagccattgcacgcaacctgcgtgaaatgtctcgcctcggcgtaccggtagtttgtacggttatcggtgaaggtggttctggcggtgcgctggcgattggcgtgggcgataaagtgaatatgctgcaatacagcacctattccgttatctcgccggaaggttgtgcgtccattctgtggaagagcgccgacaaagcgccgctggcggctgaagcgatgggtatcatcgctccgcgtctgaaagagctgaaactgatcgactccatcatcccggaaccgctgggtggcgctcaccgtaacccggaagcgatggcggcatcgttgaaagcgcaactgctggcggatctggccgatctcgatgtgttaagcactgaagatttaaaaaatcgtcgttatcagcgcctgatgagctacggttacgcgtaattcgcaaaagttctgaaaaagggtcacttcggtggcccttttttatcgccacggtttgagcaggctatgattaaggaaggattttccaggaggaacacatgaacatcattgccattatgggaccgcatggcgtcttttataaagatgagcccatcaaagaactggagtcggcgctggtggcgcaaggctttcagattatctggccacaaaacagcgttgatttgctgaaatttatcgaacataaccctcgaatttgcggcgtgatttttgactgggatgagtacagtctcgatttatgcagcgatatcaatcaacttaatgaatatctcccgctttatgccttcatcaacacccactcgacgatggatgtcagcgtgcaggatatgcggatggcgctctggttttttgaatatgcgctggggcaggcggaagatatcgccattcgtatgcgtcagtacaccgacgaatatcttgataacattacaccgccgttcacgaaagccttgtttacctacgttaaagagcggaagtacaccttttgtacgccggggcatatgggcggcaccgcatatcaaaaaagcccggttggctgcctgttttatgattttttcggcgggaataccctcaaggctgatgtctctatttcggtcaccgagcttggttcgttgctcgaccacaccgggccacacctggaagcggaagagtacatcgcgcggacttttggcgcggaacagagttatatcgttaccaacggaacatcgacgtcgaacaaaattgtgggtatgtacgccgcgccatccggcagtacgctgttgatcgaccgcaattgtcataaatcgctggcgcatctgttgatgatgaacgatgtagtgccagtctggctgaaaccgacgcgtaatgcgttggggattcttggtgggatcccgcgccgtgaatttactcgcgacagcatcgaagagaaagtcgctgccaccacgcaggcacaatggccggttcatgcggtgattaccaactccacctatgatggcttgctctacaacaccgactggatcaaacagacgctggatgtcccgtcgatccacttcgattccgcctgggtgccgtacacccattttcatccgatctaccaggggaaaagtggtatgagcggcgagcgtgttgcgggaaaagtgatcttcgaaacgcaatcgacccacaaaatgctggcggcgttatcgcaggcttcgctgatccacattaaaggcgagtatgacgaagaggcgtttaacgaagcctttatgatgcataccaccacctcgcccagttatcccattgttgcttcggttgagacggcggcggcgatgctgcgtggtaatccgggcaaacggctgattaaccgttcggtggagcgggcgctgcattttcgcaaagaggtccagcggttgcgggaagagtctgacggttggtttttcgatatctggcaaccgccgcaggtggatgaagccgaatgctggcccgttgcgccaggcgaacagtggcacggctttaacgatgcggatgccgatcatatgtttctcgatccggttaaagtcactattttgacaccggggatggacgaacagggcaatatgagtgaggaggggatcccggcggcgctggtggcaaaattcctcgacgaacgtgggatcgtagtagagaaaaccggcccttataacctgctgtttctttttagtattggcatcgataaaaccaaagcgatgggattattgcgtgggttgacggaatttaaacgctcttacgatctcaacctgcggatcaaaaatatgctacccgatctctatgctgaagatcccgatttctaccgcaatatgcgtattcaggatctggcgcaagggatccataagctgattcgtaaacacgatcttcccggtttgatgttgcgggcattcgatactttgccggaaatgatcatgacgccacatcaggcatggcagagacagattaaaggtgaagtagaaaccattgcgctggaacaactggtcggtagagtatcggcaaatatgatcctgccttatccaccgggcgtaccgctgttgatgccaggagaaatgctgaccaaagagagccgcacggtactcgattttctactgatgctttgttccgtagggcaacattaccccggttttgaaacggatattcacggcgcgaaacaggacgaagacggcgtttaccgcgtacgagtcctaaaaatggcgggataacttgccagagcggcttccgggcgagtaacgtgctgttaacaaataaaggagacgttatgctgggtttaaaacaggttcaccatattgcgattattgcgacggattatgcggtgagcaaagctttctactgcgatattcttggtttcacgctgcaaagcgaagtctatcgcgaagcgcgcgactcgtggaaaggggatttggcgcttaatgggcaatatgtgattgagcttttctcttttccgttcccgccggagcgcctcagccgaccggaagcttgcggcctgcgtcatctggcttttagcgttgatgacatcgatgcggcagtggcgcaccttgaaagccataacgtgaagtgtgaagccatccgtgtcgatccatacacgcaaaaacgcttcaccttctttaacgatccggacgggctgccgttggaactgtatgagcagtaaggcttgtcatcgccgcatttgcccggtaacgtgccgggcattgctactgtaaaatcgcaccatcatgacactcacgctcaatagacaacttctcacctcacgccagattctggtggcctttagcggcgggcttgactccaccgttctgctgcatcagttggtgcagtggcggacggaaaatccgggcgtcactctgcgcgctattcatgtgcatcacggtttaagtgccaatgccgatgcctgggttacgcattgcgaaaacgtctgccaacagtggcaggtgccgctggtggtcgaacgcgtacaacttgcgcaagaggggctggggattgaggcccaagcgcggcaggcgcgttatcaggcatttgcccgtaccctattgcccggcgaagtgctggtcaccgcgcaacatctcgacgatcaatgtgaaacctttctgctggcgctaaaacgcggtagcggccctgccgggctttcggctatgggggaagtctcggagtttgccggaacacggcttatccgcccgttgcttgcccgcacgcggggggaactggcgcagtgggcattggcgcatggtttacgctggattgaagacgaaagtaatcaggacgactcatacgatcgtaactttctgcgcctgcgtgtagtgccgttattgcagcagcgttggccgcattttgccgaagcaacggcccgcagcgccgcactttgtgctgaacaagagagtctgttggatgaactgctggcggatgatttagcacactgccaaacgtcgcaggggacgctgcagattgcgccaatgctagcgatgagtgatgcccgtcgcgcggcgattatccgccgctggctggcagggcagaatgcaccgatgccttcccgcgacgcgctggtgcggatctggcaggaagtggcgctggcgcgggaagatgcctccccctgtttacgcttgggcgcgtttgaaatccgccgatatcagtcgcaactgtggtggattaaatccgtcaccgggcaaagtgaaaccattgtgccgtggcagacgtggctacaaccgctggaattaccggcggggctgggaagcgtacagcttactgcgggaggcgatattcgccctccgcgtgcagacgaagcggtcagcgtgcgtttcaaagcggcaggattgctgcatattgtcgggcgcaacggcggacgtaagctgaagaaaatctggcaagagttaggcgtgccgccgtggctacgtgacaccacgccactgctgttttatggcgaaacgctgattgcggcggcaggggtatttgtgacgcaagaaggtgtggctgaaggtgagaatggcgtaagttttgtctggcagaaaacgcttagttaagtgaaagccggataagacgcatcaaacgtcgcatccggcgaaagtcaatcaggactcgctcaccaccaccgtaccgatttccgggtggctaaagctggtaattttatccagacgtagctcacgggtttcgccagcggcctcgacgaccagatactccacatttttgcgggagactaaatcgctggcttttgcctgcaatttttcgccatctttcagctcaagtgtcagcattaaatgatgctggcaggcgagctcaagattatcgtaatcatcacaattgattggttgatacgtatcattcattgacataatcgctcaccagtaagtttgccgcagcgtatgctgctttttccctgacagcctcagaaagggcgtcgtcggcagccatttcattcagcactttcaaaacgcagcccagcgcgtccggaacgtatcctaagtctccgctggcgatttccgcgtaccgcttgcgtattaactcacaatatttttccacatgccctcctgtcagcactctgacttaaccgtggatgcaagtctaagcctacgaagataaactctgtttcgcaaggtgactataccacactcatttctgcaatatcagcgccgcaactgcacgtattccgttacaatggcctcctgattcgaaaggagttttcttatggcgcttaaagcgacaatttataaagcgacggttaatgtggccgatctcgaccgcaaccagtttctcgatgcctctctgacgctggcgcgccacccttcagaaacccaggagcgtatgatgctgcgcttgctggcgtggctgaaatatgctgatgaacgtctgcaatttacccgtggtttgtgtgccgatgatgagccggaagcgtggctgcgtaacgatcacctgggcattgatttgtggattgagctggggctgccggatgagcggcggattaagaaagcctgcacccaggccgcagaagtggtgctgtttacctataatagtcgggcggcgcaaatctggtggcagcaaaatcagagcaaatgtgtgcagtttgccaatctttccgtctggtatctggacgatgaacaactggcgaaagtaagcgcctttgccgatcgtaccatgacgctgcaggcaacgattcaggatggcgtgatctggttatcggacgataagaataatctggaagttaacttaaccgcctggcaacaaccttcatgattgtgatttcccgacatgttgctattcccgatggtgagcttgagatcaccgccattcgtgcgcagggcgcgggcgggcagcatgttaataagacctcaacggccattcatctgcgttttgacattcgggcgtccagcctgccagagtattacaaagagcgtctactcgccgccagccatcatttgatcagcagtgatggcgtgattgtcattaaggcacaggaataccgcagtcaggaactgaaccgcgaagccgcgctagcccggctggtggcagtgattaaagatttaacaacagaacaaaaagcccgacgacccacgcggcccacccgtgcatcgaaagagcgcaggctggcatcgaaagcacaaaaatcaagcgtgaaggcgatgcgcggcaaagtacgcagcggtcgggaataaaaagaaggaatagatggtgaaaaaagcgatagtgacagcgatggctgtaatcagcctctttactctgatgggatgtaataatcgggccgaagttgatgcgctttctccggcgcaggctgccgaactgaaaccgatgccgcaaagttggcgcggcgtgctgccgtgtgctgattgcgaaggaatcgaaacctctctgttcctcgaaaaagacggaacatgggtgatgaatgagcgttatctcggtgctcgtgaagaaccttcctccttcgcttcctacggtacatgggcgcgaaccgctgacaagctggtattaaccgacagcaaaggtgaaaagtcatattatcgggcgaaaggcgatgcgctggagatgctcgatcgtgaaggcaatccgattgaatcgcagttcaactatacgctggaaccggcacaatccagtttacctatgacgccgatgaccctgcgaggcatgtatttttatatggctgatgcggcgaccttcactgattgcgcgaccggaaaacgtttcatggtagcgaataacgcagagctggagcgtagctacctggctgcgcgcggtcacagtgaaaaaccggtgttactgtcagtagaaggtcactttacgcttgaggctaatccggatactggtgcgccaaccaaagtattagcgcccgatacggcgggtaaattttacccgaataaggattgcagtagtttggggcagtaaacctgcttaaggcagaaacaaacgcaaaattgcctgatgcgctgcgcttatcaggccttgtattatccctccagtgcagagaaaatcggccagttttctctgcctgcagtccgcatgccgtatcgggccttgggttctaacctgttgcgtagatttatgcagcggactgcctttctcccaaagtgataaaccggacagtatcatggaccggttttcccggtaatccgtatttgcaaggttggtttcactatggaacatgaacttcattatatcggtatcgacaccgctaaagagaaactggatgtcgatgtgttgcgtcctgatggtcgtcatcgcaccaaaaaattcgctaacaccactaaagggcacgatgagctggtgagctggctgaaaggtcacaagattgaccatgcgcatatctgcatcgaagcgaccggcacctatatggaacctgtcgctgagtgcctttacgatgctggctacatagtgtcagtcattaatcctgcgctgggtaaagctttcgctcagagtgaaggactgcgtaacaagactgataccgtggatgcgcgcatgctggcagagttctgtcgtcagaagcgccctgcagcctgggaagcgcctcacccgcttgaacgcgcgttgcgtgccctggtagtccgccaccaggcgctgacagatatgcacacgcaggaactgaatcgcactgaaacggcgcgggaagtccagagaccgagcattgatgctcaccttctgtggcttgaagcagagctgaagcgtcttgagaagcagataaaagacctgacagacgatgatccggatatgaaacaccgcaggaaactgctggaaagcatcccgggtatcggagagaaaacatctgcggtattgctggcttatatcggtctgaaggaccgcttcgcccatgccagacagttcgccgcttttgcgggtctgacaccacggcgttatgaatcaggtagcagtgtgagaggggcgagccggatgagtaaggccggacatgtgtcgcttcgcagggcgttgtatatgcccgcaatggtagccaccagtaagactgagtggggacgggcgttccgcgaccgtctggcggctaatggcaagaaaggaaaggtgattctcggcgcgatgatgcgcaagctggcacaggtggcgtatggagtgctgaagtcaggcgtgccgttcgatgcgtcacggcataatccggtagcggcgtaaaaatcgcggaagggatgaaaaaaacagcgcctgacggcgctgtgtctggcatgcctgcaatccgggaaaccggaccaggaaaaaacttgcaggccataacagtatctacagcatataatgcaacattttgaattagcacgattttgtaggccggataaggcgttcacgacgcatccggcattttgtgcacgaggctggctttatcactgagtcagcccaacaaagcgacccgccttgatataaatcccaggcttcaggtgcccaacatactgtaactgcgtttctggcttaaacgcagagacatcaccaatacgcatatgcatcagatcggcagggctaatccagcccgattgcgccagtgtaagcggatgcccggctttggcaaatgcatcagtgacaaattccgaacaaaaccacgactttttgtctccttcgcccacactgcttaactgcgctttcgccaggccgctgacgcactgttggcgaaaatcctcggagaacggattcagtgagcacatctggcgagtcaccataaagggaataaattcgacaatgccgcgatagttataaccgctatctttgattttattggcaaacgcggtgatatctgtggcttgttgcggggtaagatccgggactcgtaagacgaaaagcttatcactatgcttcatcgcttttttaagggaaacaatctggacgccagcgcctgtcgcttctgcaacgttattatcacccagaaagattgcaacgtgactcacagaggaagtgctgaagacgcggattccaaatgaggttaccccaaggcttgaggagaacagcaaatcgccgggtttgagatcaggtgccgttatttcttttattgattgttcggtgaaagagctttgatgctggaatttgacagcccatgtttttgcctcggcatctactgctgtggctgatgggtctggctggctgatatcaacggtacaagccgaaagtaaaagaaagctggggagaaacaggcggcagtacgcctttggtttatccattttatacaatccatgtaaaaaaagggccctgaaattcaggaccctttctggcatcagcctttaatctgtttcaccagatattcgacgatgtcaccagtcttaattaactgtttctcgccgttgcgacgatatttatattcgatatcgtcgttgtcgaggttacggtcgcccagcacaatagtgtgcggaataccgatcagttccatatcagcaaacatcacgcccggacgctctttgcggtcatccagcagcacttcgataccttgtgcacgcagttcgctgtacagtttctcagcaagctcttgtacgcggaaggatttgtgcatgttcatcggcagaatcgccacctggaacggcgcgatagcgtcaggccatacgatgcctcgttcgtcgtagttctgctcaatcgccgcagctaccacacgcgttaccccgataccgtagcaacccatcgtcaggatttggttacggccatcttcaccctgtacggaggctttcagtgcttcggagtacttggtacccagctggaagatgtgaccaacttcgataccacgtttgatcagcagcgtaccctggccatccgggcttggatcgccagccaccacgttacggatatctgcaacttccggggtagcgacatcgcgatcccagttgatgccgaagtagtgtttaccatcgatgttagcaccagcagcgaaatcactcatcgccgcaacggtacggtcaatcaccaccggaatcggcatgtttaccggacccagtgaacccggaccggctttaaccacggcacgaatttcttcttcggtcgcgaaagtcagcgggcttgcaacctgcggcagtttttctgctttaacttcgttcagctcgtgatcaccgcgcaccagcagcgcaaccagcgggaagctactgccttcaaccgctttaaccagcagagtcttaaccgttttctcaatcggcagattgaactgttcaaccagttccgcgatggttttcgcgttcggcgtatcaaccagcgtcatttcctgggtagcagcagcgcgcggttctttcggcgcgatagcttctgccagttcaatgttcgctgcatagtcagaggtgtcggagaagaccacatcgtcttcaccgctctgcgccagcacctggaattcgtgagaggcgctgccgccgatagaaccggtgtcggcttgtacggcgcggaaatccagccccatgcggctgaagattttgctgtaggccgcatacattgcatcgtaggtttcctgcagggattcctgagaagtatggaaagagtaagcatctttcatcaggaattcgcgggaacgcatgacgccgaaacgcggacgcacttcgtcgcggaacttggtctggatctgatagaagttcagcggcagctgtttgtaagagctaagctcgttacgaatcaggtcagtgataacttcttcatgagttgggccgagtacgaacggacgctcgccacggtcaacaaaacgcagcagttccggaccgtactgttcccaacgaccactctcttgccacaaatcagctggctgaaccaccggcatcgacacctcgatcgcaccggcgttgttcatctcttcacgcacgatgttttcgacttttttcagaacgcgcacgccggtcggcagccaggtatataacccggaggccagcttgcggatcatcccggcgcgcagcatcagctgatggctgatcacctcggcgtcggcaggtgtctccttgagagtggagagcaggtattggctagtacgcatgttgttacggttccagttggaaggtagaacaggctcaaggcgagcctgggacaaaaaaaagtgatttagtttaccagtgcaaaagaaatgtcaaaagagaagggcgtgaatttaacgcggttccagcgcaaagacttcaaaacctgcgtcggtgacgcgccagcgaacgttaaaatcatgtagccagacggcataggttttgcccgtttcctcacctttacgataggccgggcgtgggtcctgcgccagtacttcgcggataaacagcgttaactgcggataacgcttctccagcgtcaaaagctgcttttcgacctctgcggtaaaactcaccgccatctctgccgctggcgcactttgcgcatagctggcactggcatcgggaagcgattcggcaaaggggagatacggtttgatatccactaccggcgtaccatcgaccagatccagactgccgagcttcagaatcacgctgtctttatggcaaacaacctctttcagctctaccagcgacataccaattgggttagggcggaaagtagagcgtgttgcgaaaacccccattctggcgttaccgccgaggcgcggtggacgcacagtcggacgccagccgccttccatcgtttgatgaaagacgaaaaggatccataaatggctgaacgcttccaggccgcgaacggcgtcggcctggttgtagggagcaatgagatgcagttcgccgttggcgctttttaccagacctggctggcgcggaacggcgaatttttctttatagggcgagcgaataacgcctatttgctcgaactggaaactgctcatttcgccgtaatgttaagcgcagagccgatacatacagcctgacgatagcagcctggcgtaccgctggagacttcgcagctatgcagtaataccgcattggctttcattttagaggcgttgatttgcatccgcttacgcgcggttggaatgctcggcggagagtcctgattagaggcctggcaagagtcgccactgacttcaccgagatcgcggaacggtttgccgactaattcttctgcattggtataaattcggaccggcgtggcgcgcggcgctttcggttttgcaggctccgctttcggctggggtgcagtgctttgaacgggttcgacaggggatctgcttaacatggaacagccgcttagcatgagtgctactaaacagatcggtaaagcacgcatagtatttcctcaatgtatgatcaaaacgtcaatattgaatcaggagcttgtaaaaatgacaagacgggcaagcgcccgtcctgaatgatattacaaattgtggaaacagcctaaaaattaccagcctttaacagcgccgccgttaaacactttgtttgctgcttcgtaaacttcatcagactgataagcctggacgaatttcttcacgttctcggcgtctttgttatcttcacgcgttacgatcaggtttacgtacggggagtctttatcttcgacaaagataccgtctttcgctggagtcaggccaatctggctggcataggtggtattgataactgccagagcgatttgcgcgtcgtccagagatcgaggcagctgcggtgcttccagctcaacaattttcagattttttgggttctcaacaacatcaagaacggtcggcagcaggccaacgccatctttcagtttgatcaagcccactttttgcagcagcagcagtgaacgaccaagattagttggatcgtttggcacggcaacctgcgaaccatcctgcagttcatccagtgatttgattttcttggagtaaccagcaatcggataaacaaaagtgttgcctactgcgaccagtttgtagccacgatctttcagttgctgatcaaggtacggtttatgctggaaggcgttggcgtcgatatcgcctttgctcaatgcttcgtttggcagaacatagtcgttgaaggttaccagctcaacgtccaggccatatttgtctttcgcaactttctgcgcgacttctgctacctgctgttcggcaccaacaatcacgccgactttaatgtgatttggatctttttcatcctgaccgcagcctaccagtgccagtgatccaatcagggctcccactgccgcaaaggttttgaatttgaacgccataccttattccttcttcaattatttatgttgtgttgaacgttacttgcgagtgacagcccggacgatgcggtcgcctgcgaactgaattaaataaaccagaatgaccagcaataccagtaccgtattcatcaccgtcgcgttatagccgatgtagccatactgatagccaatctgacctaaaccaccggcaccgactgcaccacccatcgcggaataaccgaccagggtaatcagggtgatagttgccgcattcaccagacccggcaatgcttccggtaacagcactttacggacgatctgcatcggcgtggcacccattgcacgggaagcttcaattaacccggttgggatctccagcagagcgttctcgaccatacgggcaataaacggtgctgcaccaacggttaacggaacaatcgctgcctgcaaaccaatcgatgtaccaacaataacgcgggtaaacggaatcatccataccagcaagataatgaacgggatagaacggaaaatgttcacaatcgcagaaacggtacgatacagcttcgcgttagcaataatttgccccggacgcgtgacataaagcagaacgccaaccggcagaccaatcacaaagccaaaaaaaccggatacgaaggtcattgccagcgtttcccatacgccacgaaccagcagccacatcatcggctcagacataacccagtacctctacttttacatggtgttcctgcagccaggcaatggcggcttgcgtatcttgttgtgtgccgtgcatttcagtcagcatgatgccgaacttaacgccaccggcgtagtccatctgcgcgctaataatgttgttgttgacgttgaaacgacgcgcggtttcagaaagcagtggggcatcgaccgattgaccggtaaactccagacgcaacatcggcacgcagtcagtaaatggctccgcttgcagacgttcctgataatcttccgggatatccagatgcagggtcgactgaataaacttctgcgccagcggcgttttcggatgcgaaaacacttcacttaccgtgtcctgctcgatcagttcgccattgctgatgaccgccacgcaatcacaaatgcgctttacaacgtccatttcgtgggtgatcaacagaatcgtcaaacccagacggcggttgatgtctttcagcagttcgagaatagaacgtgtcgttgccgggtccagcgcgctggtggcttcatcacacagcaatactttgggattgctggctaatgcacgggcaatcgccacacgttgtttctgcccaccggaaagattcgacgggtagctatcatgcttatcgccaagaccaaccaatgacagcaattccgtcacgcgacgtttgatctcgtctttcggtgtgttgtccagctccagcggcagagccacgttgccaaaaacagtacgcgaagagagcaggttaaaatgctggaaaatcataccaatctggcggcgagctttggtcaactcggattctgacagcgtggtcagttcctggccatcgaccagcacgctaccctcggttgggcgctccagcaggtttacacaacgtataagcgtactcttacccgcgcctgaggcaccgataacgccataaatttgtccagctggcacatgcaggctgacgttgttcaacgcctggatggtgcgggtgccctggtggaacactttggtgatattcgaaagttttatcattgattatttattatcgtcattaagttagtcgtggcatctcgaatgcctgaaacgggcaacgccgtcaatgaaatggatgttaaggcatccagacgtctaaatcaatcaggtttatgcgaagagcactttcttgcaggtcgaaacatgcgatactagcgtcacatgccttattaaggagctataaaaggtggcaaagagcgtacccgcaatttttcttgaccgtgatggcaccattaatgtcgatcacggctatgtccatgagatcgacaactttgaatttatcgacggtgttattgacgccatgcgcgagctaaaaaaaatgggctttgcgctggtggtagtaaccaaccagtctggcattgctcgcggtaaatttaccgaagcacagtttgaaacgctgaccgagtggatggactggtcgctggcggaccgagatgtcgatctggatggtatctattattgcccgcatcatccgcagggtagtgttgaagagtttcgccaggtctgcgactgccgtaaaccacatccggggatgcttttgtcagcacgcgattatttgcatattgatatggccgcttcttatatggtgggcgataaattagaagatatgcaggcagcggctgcggcgaacgtgggaacaaaagtgctggtgcgtacgggtaaacctattacgcctgaagcagaaaacgcggcggattgggtgttaaatagcctggcagacctgccgcaagcgataaaaaagcagcaaaaaccggcataatgattaaaagatgagcaattgaaataaaaatgcatttttccacttgtcttcctgagacgactccctataatgcgcctccatcgacacggcggatgtgaatcacttcacacaaacagccggttcggttgaagagaaaaatcctgaaattcagggttgactctgaaagaggaaagcgtaatatacgccacctcgcgacagtgcgctaaagcgcgtcgcaactgctctttaacaatttatcagacaatctgtgtgggcactcgaagatacggattcttaacgtcgcaagacgaaaaatgaataccaagtctcaagagtgaacacgtaattcattacgaagcttaattctttgagcatcaaacttttaaattgaagagtttgatcatggctcagattgaacgctggcggcaggcctaacacatgcaagtcgaacggtaacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagcttgttggtggggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagcgttctttgaagtgctcacacagattgtctgatgaaaatgagaagtaaaacctctacaggcttgtagctcaggtggttagagcgcacccctgataagggtgaggtcggtggttcaagtccactcaggcctaccaaatttgcacggcaaatttgaagaggttttaactacatgttatggggctatagctcagctgggagagcgcctgctttgcacgcaggaggtctgcggttcgatcccgcatagctccaccatctctgtagtgattaaataaaaaatacttcagagtgtacctgcaaaggttcactgcgaagttttgctctttaaaaatctggatcaagctgaaaattgaaacactgaacaacgaaagttgttcgtgagtctctcaaattttcgcaactctgaagtgaaacatcttcgggttgtgaggttaagcgactaagcgtacacggtggatgccctggcagtcagaggcgatgaaggacgtgctaatctgcgataagcgtcggtaaggtgatatgaaccgttataaccggcgatttccgaatggggaaacccagtgtgattcgtcacactatcattaactgaatccataggttaatgaggcgaaccgggggaactgaaacatctaagtaccccgaggaaaagaaatcaaccgagattcccccagtagcggcgagcgaacggggagcagcccagagcctgaatcagtgtgtgtgttagtggaagcgtctggaaaggcgcgcgatacagggtgacagccccgtacacaaaaatgcacatgctgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcacgcttaggcgtgtgactgcgtaccttttgtataatgggtcagcgacttatattctgtagcaaggttaaccgaataggggagccgaagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaattcatctccgggggtagagcactgtttcggcaagggggtcatcccgacttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacactgtgtgttgttgggtaggggagcgttctgtaagcctgcgaaggtgtgctgtgaggcatgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacaggttaatattcctgtacttggtgttactgcgaaggggggacggagaaggctatgttggccgggcgacggttgtcccggtttaagcgtgtaggctggttttctaggcaaatccggaaaatcaaggctgaggcgtgatgacgaggcactacggtgctgaagcaacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgatatgtaggtgaagtccctcgcggatggagctgaaatcagtcgaagataccagctggctgcaactgtttattaaaaacacagcactgtgcaaacacgaaagtggacgtatacggtgtgacgcctgcccggtgccggaaggttaattgatggggtcagcgcaagcgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgttgacccgtgatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgactccttgagagtcctgaaggaacgttgaagacgacgacgttgataggccgggtgtgtaagcgcagcgatgcgttgagctaaccggtactaatgaaccgtgaggcttaaccttacaacgccgaagctgttttggcggatgagagaagattttcagcctgatacagattaaatcagaacgcagaagcggtctgataaaacagaatttgcctggcggccttagcgcggtggtcccacctgaccccatgccgaactcagaagtgaaacgccgtagcgccgatggtagtgtggggtctccccatgcgagagtagggaactgccaggcatcaaattaagcagtaagccggtcataaaaccggtggttgtaaaagaattcggtggagcggtagttcagtcggttagaatacctgcctgtcacgcagggggtcgcgggttcgagtcccgtccgttccgccacttattaagaagcctcgagttaacgctcgaggttttttttcgtctgtatatctattattgccagaatcgcaaaaatcctctgcattttacgctctttttcctcaacagtctgaagcccataatcacctcagttaacgaaaatagcattaaaagaggcatattatggctatccctgcatttggtttaggtactttccgtctgaaagacgacgttgttatttcatctgtgaaaacggcgcttgaacttggttatcgcgcaattgataccgcacaaatctatgataacgaagccgcagtaggtcaggcgattgcagaaagtggcgtgccacgtcatgaactctacatcaccactaaaatctggattgaaaatctcagcaaagacaaattgatcccaagtctgaaagagagcctgcaaaaattgcgtaccgattatgttgatctgacgctaatccactggccgtcaccaaacgatgaagtctctgttgaagagtttatgcaggcgctgctgaaagccaaaaaacaagggctgacgcgtgagatcggtatttccaacttcacgatcccattgatggaaaaggcgattgctgctgttggcgctgaaaacatcgctactaaccagattgaactctctccttatctgcaaaaccgtaaagtggttgcctgggctaaacagcacggcatccatattacttcctatatgacgctggcgtatggtaaggccctgaaagatgaggttattgctcgtatcgcagctaaacacaatgcgactccggcacaagtgattctggcgtgggctatgggggaaggttactcagtaattccttcttctactaaacgtaaaaacctggaaagtaatcttaaggcacaaaatttacagctcgatgccaaagataaaaaagcgatcgccgccctggattgcaacgaccgcctggttagcccgaaaggtctggctcctgaatgggattaagcctctctgacagctcctccgggagctgtttttacatgctcgctaaggaaatcgataaaagcccggatgcgcgtacttaccgcacggtcgctgtaatagactgcactgaatggcattgccactggcaacactttatctgccattaactccaccaattctccgcgagcgatttctttgtcgatcatgtagtcggacaaacacgcaatcccgttgccactcaggcaaagctgtttcagtgtttccccactattggatgacaaaccgtacttcacctcatgtaattgtccatcactacaggctatcggccaggtattgagggaagcgggttcagtgaatcccaggcaaacatgttgctttaaatcgtcgatcgtttctggcttcccgtagcgggaaatataatcgggggaggcgataatttttcgataactattaaataacggcctggcacgtaagctggaatccgttaacgtaccggcgcgtatcgcgacatcaacttttctttcgatcaaattaataatcgtttcggaggagactagcgacaaagtgacttccggatagcgttcacggaaaggcttaatcaacggcatcagaaagtgcagcaccactggagttgcggcatcgatgcgcaacagtccacgcggtgtattacgcgtctccataatttctgattctgccgctgccatctcctgcaaaattgactgtacgcgacgaaaataacgctcgccttcttccgtcaggctaagttgtcgcgtggtccgattaagcaggctaacgccaagtttcatctccagctttttcactgcccggcttaccgctgagtttgcttgccctaattgttccgctgcccggctaaagctgccgctttcgacgaccgaaacaaaaatggcgagttcttccgacgtggctttcatttttgctcctgttgcaaaatagaagagatattttgaatttatttgtcattaaaccatcaggatgcgtgatatgtcatccgatttaatgttctcaacaatgagcaaaattctgaccggtgtaagcacttgcttacataacaatatacaattgctcgttgaaagagtgagctaaaatccctataacagtagaaccctcccgagtgcggaagggttgacgtaatagaggtttcaaagtcaaaagtgcgaaaaaacacctatgccatgcgctatgttgccggacaacctgcggaaaggatcttaccgccggggtcttttgcgagcatcggccaggcattaccacctggggaaccgttaagtaccgaagagcgtattcggatcctggtgtggaacatatacaaacagcaacgcgctgaatggttgtcggtattaaagaactacggcaaagatgcacatctggtgttattgcaggaagcgcagacaacgccagagttagtacagtttgcgaccgctaactatcttgccgccgatcaggtacccgctttcgtactgccacaacatccttctggcgtaatgaccctttcggcggcacatccagtgtattgctgcccgttacgtgaacgagaacccattttgcgtctggcgaagtcggcactggtgacggtctatccattacctgatacccgcctgttgatggtggttaatatacacgccgtcaacttcagtctgggcgtggatgtttatagtaagcagttacttcctattggcgatcagatagctcatcacagcggcccggtcattatggcgggagatttcaatgcctggagccgtagaaggatgaacgcgttatatcgctttgcgcgggaaatgtcgctgcgccaggtgcgttttaccgacgatcagcgccgtcgggcgtttggccgtccgctcgattttgttttctaccgtggtctgaacgtcagcgaagcttctgtactggttacgcgcgcttccgatcacaatccgctactcgttgaattcagtcccggcaaacctgataaataaggtatgtcaggtctgccacagggcagaccaaagtttggcgctgcccttttatactcaaataacaaaaggacagcgcaatgacaacacaatcccaccatgaccacgtagaaaagcagtttagctcgcaggccagtgagtatttaaccagtaccgtacatgcatccgggcgagatttacagcgcctggcggtgcgtctggctgattatcctgatacaagtgtacttgatatgggctgcggagcagggcatgccagctttgtcgctgcgcagaacgtgagcgcggtggtggcgtatgacttatctgcccaaatgctggatgtcgtggcacaagctgccgaagcccggcaactgaaaaatatcaccacccgccagggttatgccgaaagtctgccatttgccgataacgcatttgatattgttatcagccgttattctgcccatcactggcatgatgttggtgcagcactgcgagaagtgaataggatattgaaacctggcggtaggatgattgtgatggacgtaatgtctccgggtcatccagtgcgcgacatctggttacagacggtagaagcattacgcgatacctctcacgtacgaaactacgccagcggtgagtggttgaggttaatcaatgaagccaatctgatagttgataatttaattacagataagttaccgctggaattttcttcatgggtcgcgagaatgcgtacgccagaagcgttagtagacgctattcgcatttaccaacagagcgcatcgacagaggtgagaacgtattttgccttgcagaatgatggctctttcaccagtgatatcatcatggtagaagcacataaagcagcataaataaaaaaggcaccgggggaatcggtgcctttttattatctggtttgtcaggaatctggcatgttgttgtttttcacaaacaacgtcagcttatcgcctggttgcagattcgcagtgtcgctgttccagcgcatcacatctttgatgttcacgccgtggcgtttagcaatgcttgaaagcgaatcgcctttgcgcacacgatacgtaatgctatcgctgttgtttgccagtcgctgtgcgctactgcctgcaccaatcgtcaaactttggcctggcttcagcttagatccgcgcagtttgttccactgctgcaaatctttggtgcttacgccgagacgtgaagcgatacttgaaagcgtgtcgccagagcgtacggtgtaaacacggctgttaagcggcgtattgtcggcaaccagcgtcgactgtacagcagcaatttcgcctgaagcgagagattcacgcagttgatctgcatgcttctttggcaccatcacgtattgcggaccacttgcgcccagcgtggagcctttcacgccagcgttgaatgtcttcagcttgctgacggaaatccccgccatatctgcaaccttcgccatttcaaccgggctgctcaggtgcacacgcgccagagcacggctttcatcggtcgttggcagacgtacgccataacgcttgctgtttttgagaatatcactcaatgccagcattttaggcacgtactgcttcgtttcctgcggcaacggtaacgaccagaagtccgtggatttcccacgcgctttgttcgttttaattgccttcatgacccgaccttcgccgctgttataagccgctacggtcagaagccagtcgccgtcaaacattttgttcagacgctgcatcatattcagcgcggcagttgttgaagcaacaacatcgcgacgcgcgtcataattgcgggtctgtttcaaaccataattgcgccccgtgctcggaatgatctgccagatgcctgcggcattggcgccagacgttgcgtgaggatcaaaagcgctctccactatgggtagtagtaccagttccataggcatgttacgttttttaacttgcccggctatccagtacatatacggctctgcccgtaaagttacatcgtggagatagctcttattgcgtaaatatttctgtttctgttcgcgaatccggtcattttccggaattcccatctttagctcgtcgccaatgaaagcccacaagtcaccatctggcgcgatagacgtcccatcgtccatccatcgtgcctgacttgtaaactttgctgcttccccttgaccagctgcagaaaggctctgtgcgtgctgttgtacgttgccggtactctggcaacccacgagcaggacagaggcgagtaatatcgcttttgccttcatgtgtgtgtcaatagttgcttaaaagacgaccgatcataacggcgaacggagccgatgacaagaaagttttatcagaacctatctttctttgaccttaaccatgcaaaacgttcttcaggttgttgcaataatgtttcttcattaattacattaattaaatcaatatcttctgttcttaaaaaaacattaatttgccgctcatttttcagaattacgggtagtgttatttgattttttgcccgtaactccttaactttacgataataatcatttatggacaaatcgtgcggaagaatactcaaagcaaacttcatatttgataacgtatattcatgagcacaacataccaatgtatcgtcaggtaacgcacttaactttttaagtgattgatacatttgtgatgctgtcccttcaaacaacctaccacacccaccagaaaacagcgtgtcgccgcaaaatagataaggtttactgaagtaacagatatgtcctaaagtgtgacccggtgtggcaattacactaaattcatgccccaaaacgaaggcagtttcgccatctttgactacctgtgttgttcccttatcttgtgtctcttgtggaccatacaccacaatttgcggaaacttttccaccagttcttttacgccgccaacgtgatcgtgatgatggtgggtgagaaatatggcctccggttgccagttattggcggtaatggcgtttaatactggctctgcgtctccgggatcgacaatcaggcagcgacctgcttcatcattcaaaacccagatgtaattgtcatcaaaggcgggaatactgttaagattcatagattacctcttagtgtgaaacggaaggttgtgatgaaaccggcaagagtccctcaaactgtcgtggctcctgattgctggggcgatttgccctggggagagctttatcgcaaggcgctggagcgccagctcaacccgtggttcactaaaatgtatggttttcatctgcttaagattggcaatttaagcgcagaaatcaattgcgaagcgtgcgcggtttctcatcaagtgaatgtttctgcgcaaggaatgcccgtccaggtacaggcggacccacttcatcttccttttgccgataaatccgttgatgtttgtctactggcacatacattgccgtggtgcaccgatccgcatcgtttattgcgtgaagccgatcgggtattgattgatgatggctggctggtgattagtggcttcaatcccatcagtttaatgggattacgcaaacttgtgccggtattgcgcaaaacctcgccctataacagccggatgtttactctgatgcggcaactggactggctctctttgttgaattttgaagtgctgcacgccagccgtttccacgttctcccgtggaacaaacacggtggaaaactattgaatgcacatattcctgcgcttggttgcttacaacttattgttgcccggaaacggactattcctttaacgctaaatccgatgaaacagagtaaaaacaagccacgaattcgccaggcggttggagccacccggcaatatcgtaaaccacaggcttaaacttcgacttgatagcctgtatcttccagtgtgggattcattgccgcagcacgggccagttcatcacagcgttcgttttccgggtgtccggcatggcctttaacccattcccatttgatttgatgctgccccaatgcagcatcaagacgttgccagagatcgacattttttactggttttttgtctgcggttttccagccacgttttttccagctatggatccactgagtgatcccctggcggacatactggctgtcggtactcaaaatgacttcgcaatgttcttttaacgcctccagcgcgacaatagcggccatcaactccatacggttgttggtggtgcgggtgtagcctgcgctaaaggttttctcgcgtccgcgatagcgtaaaatagcgccgtaacccccaggtcctggattgcccagacacgaaccatcggtgaaaatttctacctgtttaagcatctctggtagacttcctgtaattgaatcgaactgtaaaacgacaagtctgacataaatgaccgctatgagcactgcaattacacgccagatcgttctcgataccgaaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatatccgcggcgcggagttggtgatccataacgcagcgttcgatatcggctttatggactacgagttttcgttgcttaagcgcgatattccgaagaccaataccttctgtaaggtcaccgatagccttgcggtggcgaggaaaatgtttcctggtaagcgcaacagcctcgatgcgttatgtgcccgctacgaaatagataacagtaaacgaacgctacacggggcattactcgatgcacagatccttgcggaagtttatctggcgatgaccggtggtcaaacgtcgatggcttttgcgatggaaggagagacacagcagcaacaaggtgaagcaacaattcagcgcattgtacgtcaggcaagtaagttacgcgttgtttttgcgacagatgaagagcttgcagctcatgaagcccgtcttgatctggtggagaagaagggcggaagctgcctctggcgggcataaatacctgtaaaaggcgctaaaaatagcggcttgggcgatttttgcagcaaacgattcaaaagatgagaaaaaccgttgacgaagggtgaggcaatccgtaatattcgcctcgttcccaacggaacacaacgcggagcggtagttcagtcggttagaatacctgcctgtcacgcagggggtcgcgggttcgagtcccgtccgttccgccaaattcactcatgaaaatgagttcagagagccgcaagatttttaattttgcggtttttttgtatttgaattccaccatttctctgttcaatgattttattctggcgtaagtgcgtgattctcgcttgttgtctcattcattaaaattcaataatgatatcgaaccattcagcttaaatatatttccagagaataaatttatattgattaaatgaatgtatatttcaaattgattttgtttgttattatttaagtggggtatataattagagtccgttatcaatgctaaatattctaatcattatgacaggcgagggagtgtccaattatgaattcaaaaaagctttgttgcatatgtgtgttattctcgctgcttgcaggatgtgcctctgaatcttctattgatgaaaagaagaaaaaagctcaagtcacacaaaataatattaataaaaacactccccagcaactgacagagaaagatttattcggtaatgaaaccactctggccgtatccgaagaggatattcaagctgcgcttgatggagatgagttccgcgttccccttaattctcctgtaatacttgttcaatccggcaaccgcgcaccggaaaccattatgcaggaggagatgcgaaaatattatactgtttccacattctctggtatcccggacaggcaaaagcctctgacttgtaacaaaaacaaagataaaaatgagaacgaggatgttgccagtgctgagaatatgaactggatgcaggcactgcgttttgtggctgcaaaaggacatcagaaagcgattattgtttaccaggatacattgcagacaggaaaatatgactctgcgctgaaatcaacagtatggtccgactataaaaatgaaaaactcaccgacgctatctccctgcgctacctggtacgtttcacgctggtggatgtggcaacaggtgagtgggctacctggtcgccggtgaattatgaatataaagtgcttccaccattgcccgacaagaatgaagccagtacgactgatatgacagagcagcaaatcatgcaacttaagcaaaagacctataaagcgatggtaaaagatttggttaaccgctatcaataataaattatatctgccgccaggaatttctggcggcaataatacaaaattctttgcataagaaatttttcttgacaaagacagtgcaagaaaggacatggaatccggagttaaaaactgtttgttttagaatatttaattatttaactgctgaatcttccttgcgagaaatatattcattattacatttcatgccatttttaatatagattgctcctgggaaaattcccgtattattaccgcaggggtgataattagcattgacatatcctgtgacaaaaggagctattaaaggtgctattacgatagctattagtaaaaatataagagttagctgtattgttatgtctgtggcgaaattgactaccttcgtttttttgattaagaatgattttattatcgtaagtaaaattacatgaacatttaaaaaggaaaacgacatgaaaccaaagcacagaatcaacattctccaatcataaaatatttccgtggagcattttattattgaatatagaggtttaactccggtaaaaaacaaagaagcattgaatgcagggaaaaataatatggccataaaaaacatcgaaagaaactcttttaatttaacatgtaaacgcatggttaatcctcatatcacgggtggagtgttaagaacatacataaatggagtcatgttttcccttttccatttatcaagttcctgttgccgttttagtccatctctaattgcatattttaatttttctgataaatggcattgagcatcgatttcatttaaaacaactgtacacactatccctgtcagtaaaattgctcctccgacaagaattactggaaagccaaagctaacacaggcaaaagaagccaggcttccaatagcggttgcaacaccaccggctataactgctttggccacatccattgaaaaatcgccaagaaaattaaccagatctcgctctgaactcataataaattctatggttctccaggctactgaaaaccagatacagaacttaactccttttattgattcagataaagctcctcgccagccaatagcgagttccagaacttgaggcgctcgtgaagagaaaatatatttaccgagcttttctaaaagccaggggctggatgttgtgatttttatatatttctctccaagtatttcaaagtaacttgcttttgtatactttaaggcattaaggttaaatataattttcccattgtcatcaaactcagtcattaatttacccgcgttaactaaccaggcgagtgtatcttttatacctgaaggatgtgtagtgataaaatgaatgtaatcaaatgatgttattgggctgagtattttttttgcaacatcaagtgtcaagagaataacatgatgagtgttctgatgccttaactcatcaatgagtgggacgtcgttaagataagggtgctgaggtactagctggtttatcggctgagccccccgaagaatgtcacccacataatcagcccactgtgcattctgtgtgttgttgttattccttaaaccagccattttatctctccgcaatagtaatttattatgttattacagtaagttactgtacacgatcctgccatttactcattgcattcgtaccggctaacgtatgctcccaggaaatatcttcataaataaaggcaattctctcctgtggttccagttctttttccaggacagcatgcggtgtgacaaaatcaatacttgatattcgggcttttgacagatttattttataataaggctggtaaatacccgctttactggttcggtagagtataaattcacatattgccattttttcattgtcactaagtgcttttgccagcaatggtgaggatttatcaaccggtttggtgataattaattcatgatgattgacattttgacttcttgagatggaatgcattaacgcataaaccatgatctgatctttatgttctggctgcgctttgtttccgacagaatcaagcgttgagcaacctgctgaaatcagcccttgtgtctctccactcaaagataaataacttatatttgccatgataatctcctttaattaaataattatttttcggccgtggtaccggttgccgcctctggcatgacgttattcttcagcagcagccagcggcttaacacgccttcgagtcgctcattaatttgtttttccagcgcatctgtattctgcttctgcgcacgggcatcctggtactgcgtcaacagagactcaacgggtgtttcctgccccagtccccgctccgcctgccagatgacatttttgatataggaaagggttagtccctctttctcgcgctgcatcactagatctgcaaaagcatgtaagtcctggcgggtctgcaaccagccacgcaactgcgggctactctgtgcgcgggttttgagtgcctcattccattgtgtcgaggcctgttgctgttgcaggctttccggccagcgactgtcggcaacacgcatcatctgcatcccggtttccagcggctgtaccggggaggtatcaagaagttgttgcagcctgcgctcatagttttcgagttcaggtgaggccatccacaccgttgctgcgccctgagcggtgtcgttaacctgtaacagttgctgctgtaccggatagacctgccaccaccacaatgctgaggcgacagccactgaacaggcgatccctgcgataaaccctcttaccgtactgccttgctttatcacactggcctgtgggggattctctgtcagactgcgcacttccactttcatctcaggcaggccgggcaggggaggcactaccgcttctggtgtggaagatgcctgtgtttccggggcataaatcagcgttctgaccgtggtctgtgcggcgttctcagtgttactcttcagctggggttcaagccgtttacgcgtgttctgcataaaatagagcagattctccacgcgcggaacgcgcttcagttccacctgctggagcttatcgcagataagctgcaatgcccgctctgtgcggtagatcagtggtaggtcggattccgcaaaggagatttgctgacgcagaatattgccggttcgggagttaaaccagtccagcatttcagtacgcgccgggccgccctgcggccagaacttatcccagtcgtggcttaccattgccgccagcagttccgcaccttcgcagaatcccgccagtccctgtgtccgtgtccgggcaagcgtatagtaggtggcggtgtgtaaatccacaccgttggctttaaaaatcgccagtgccagcgactccaccagtttccagttcagctcaggctgtgacgggtggctggctttgtttatttcctcgcggatggcactgaattccggcagcccgcgcgggtcactgccggtaacgatagtttgtgtcagtacgttactattcatccctgcctcctcagtacagtgtgtctgacagaccaaactggctgaacaacccaccgctgaacgggttatcttccgtgtcggtatgcacacggtaggtcatcgcgccaccgtccacgctaaagcgcacggtaaagttgccatcctgtactccggtcagttgtccggccccgaacaggcggaactgcgcccacggcccgctgaagctgatactgcgcggcgcgttgccgctggtgccgatgagcgtcagcttactttcgttgccttcgcgcatgttgttaggccagaccagatgggcggtatagttacggccctggctgtaatcgactaactgaccgtcaaggttcagtacactgcggcgtttattgcctgaaagcgataccgtttccacggcaaaggatgttcccagaccgttctgtttgctgaagaagatgtcacggattttctgcgcagtttccagttgcgcaataatatcttcgcgaataatgacgttgttatcgccatcctccagactcaggtcattatcgataaacagcttcaggttctgctggtagaaggtatccagtatgccatccggtttaaagaagcgttcgaaggcatccagtgaggcatcctgtgcagaacgcggattaaacggatagttatttgccagttgctcgttaaacggtttcaccacgctgtcgcgccagtccacttccatataatgaacagcctccaccatcaccacatgccaggcctggtcagtcagtctgccaacccagcggttgagcggagcaggcagcgtttttgccatctggcgggtggcgaatatcggatcgctgctgttctgatcaagccgtaactgcacggctttcagcgccgatttccctggtacaggcgcgttctggattgccagcaggtagcggtgcaactcggtgagttgctgatacacggcctgcatcgtgctttctttgtctttctgtactgccagggtactgttttccggggcgaattcatgcccgaggcgggtgagtaactggtaatccggctctgccagggcttcctcccgttctttggcagagagtttttcagaaaagacgcctggctgtgtgttgtcacgcagcacggtcagcgcccgctgcaaaggctggtcgccgctgataacctgctccagcgccccggtcagttgtccgatggactcaaaattgcggatattcagattgtccatcccggcccgccaggtggcggtgtagtcgctgatatactgctcggtcaactggcgctggatttccgcgcggtcggcgtcactgtatttcacgctgcgggtaaggttaagtacccaggaatccatcgccgtcagttcaaccagttcatcgcgctgttttacaaaatagctttgcaggccgtaacgggtaagaaactgtggaacaaccagtttgttgtcatcggcagatgtaaacacctggtcaaaggttggccctacctggtcacgcagattgaggtcggcaggaagaacgcccagcgcccgcgttttcaggctctggtaaacccgctggtagacaggcagtttgctcagttctttctgtgctgataccacgggcttgtcatatggcgtccagcggctgatggcgtcaccgtcgcccgcctgacgctctgcgtgccagtcagtatgagccagcgcgtagtcaagatgggacatcagttgtgcctggatatcgcgctgaccgtggaacttttcgctccagcgttttgccatatactgcttcaccacctgattgttacgtccgcttttgtcctccagcattcgcatcacgcgcagcaccgcgagtttttcttcactctccggcggcgcggcgttcagcgctttgaccagcccgttaaacagcgagggcaggtaacgttgctccagcagttgcagataggtctgttccacataaggcccgatacgtcgtccctggtacagtcccatatcggccagacggctgcggtcgccccagtcgccataggccagtgtggcatcgcgtaccgggttcaggagcggcagttgcaggttgccaaagtcatcttccccctgcggaggcggcacgtccataaaggctttggcctgcttaagcacggtgatgccagactgatagttaccgttgtaatagtgatgccagccggtgatgagcagcagtgctgccacgccgcctgtggcagagaaaaccgtcaggcggcgacgggaacgtatcagccaggcgcggctctctgttgccagattaggctctgcgagtaatgcctgcgggaacaggctgcgggtgaaataaggcgcggtgtccaccaggggccaggacgccagtgggttattgcccagccggtactggcgggcggcagactgggtgaatatatcatccatctgtccacgctgaagcgaagaggtgagatagacaccacgcagcatcacgttcatattttcgccatcaagcagaccctcaagcagtgacaccagcggttcacggcttccctgcatctggcgggaaaaactgaataaagacgcgcgggtgtgagtctgagcgaccatcagatccggcaacgccagattcattcgatccacccatgtctgccagaaagcattcaactctgttcgccagtcatcattttcatgggcacggcgggtgaacgtgacgcccagaatcgcatcgcgatcctgtctgttcagggactgaaacagggcggcaaaaccctgcaataaatcaagccgggtaagtaccacgtaaaccggtaactggcagtgaagatgctggcgtatatcctgcaagcggctgcgcagcgcctgtaacagatgctcgcggcggcgtttgtctgcggtaagcagatcgggtaaatcgagtgtcagaataatcccattcagcggctggcgcgcgcgcttttctttcagccagccgagggcatgttcccacagacggcgatgcaggatatccgcatcagcgggagcgcagagtgtgccgtcgatatcaaagatcaccgcctgtttaccgacatggggcgtgaggtacaggcgttgttctgcgccgcgtgcgccctccggggcataaataatgtcggacggaaacccctcgcgcagcagtgtcgttttgccactgcccgccgggccgatgaccatataccacggcaactgccacaggaaacggcggttgtcgagatggcgttgcaggcgcagcagccagcggtcaagataacgctgctgggcgttcagttccacgctgagcggatcaacggcttcctcgcgctgttgcttttgcattttttcaagctgttgcaggcgcttcatcacccggacggtaagccacatcagggcaataatcccccacgccgccgttgccagccagcggttcgccagtggtttgagccactgttcttcatacagcgtccacgtcgggcctttccaccagatccacaccagcagaaaaatccacgccagtatcagcagccagaaagcagagactttaaaccggggcatcgccggtcgcagggctgatttgagtccgctgagtagtcggggtgttggtaatctgaacacaaaaactcctgttctcttttattgttctgccgtgaatttttgttctagctgctcaagcagggacggctcccagtcagccaccatcatctgcaatcccatcctgaacaacatccggtactgctgctgcgcaagctgtaccagccccgcctcttccgtcaactgtgcggcaaggtactggcggtgaaactgatcgcggggatcgccttcgggtagcatgtccagatatcgcagcgccgcctccagaccctgctcagcaaaacaggctctggctgccttcgattcctcaccgatttgcgcaaccggtgcaactttggcgtcgggcgaagctgccagccattgtttcgtctgctcactgataaacggtgtgtggtcattaaacagcagcccggtaagctggggcagacgctcaaggaagcggatgacctcatcgcggatggcgtctgccacctgtttgtaacccagacgcagcgccgtctgtgcagaaaggcagtgaccatccagccagtaaggagccagcagtacgcttttctccacctgctgccacagcgccatatcggcactaccgagctgagcatggtaatctgccaccatatcggcggagaccgcagccagtggagtacggccatcgctttccgcctggggcgtactggtgatgttctgccaaagcgcatggcggcgcagacggtagccctgcggtgaatccggctggcgttcacataaaatggccgccacttttaacagcgtgtcgcgccaggctttgtcgtcgtgactgtcgatgacgatttggggagccggagcactgggttgcgtcacgccgctttcagacgtggcggtggtctgtggtgaactaccggaggccgccggagtggggacaggagccggtgccgcacgattaaacgcacgctggtacagggcaaaaagatcatcagtagcctgtgccagttccggggcgttatgtgactgccagcattgcgccagttttgccagttcccctgacagcgcatcgcgctgctctgtggcggcgttctgtgaaaaaccttcaatacctgtttcaaagcgtttaatgacctggctggcaaagcgttttttatgcgccatattctgcggcgcagccaccgcccagtaatgctccacatacagcgccagcaggcgcaatgcgagatgaggatcaccggcgtgttgcagggttctcagcagatgcgccagcagacgaaaatccttactctccgaagccagaatgaccagcccccggcgctggagttccgggatatccagttgactgtgggccagcgatcccagcttgacgatttcgccgtcgatatactcccagttcgggttgtcatctttcagcgccgatgccagtttctcttccggcaggttttccagcaggtgcgatatccagacattcggatcgcgtaagtccattgccatatttttattctcccgcccagtggcaggcatcgcgcaggggagcaatcgcccttgccagcccgtcaatgttaaaggtcagctttccggcggcattgtctgcgccggtatccaccgtcagcgtttttgcgccgaacagttgcttaatttcatcaatcccggataacccccggctggactccagcagggtgccgttctcgcgcacaaaccagtggctgcgcaatgcccggttgtcggcattcagagtgacggcgatatcatggacatccagagggtgcatcagcgccacctgcatccgggtgatattgtccacgcaactgaacatcagcaccgggcgtggcggaacatgaccgatagccggggtggttatcaccaccgtcgggcgctcccccggcacctgcgtcaccagcagttctgtggtgttgccctcgcggcgtttttcctgctctgtggcgcgggtccaggcctcgcccacaaaaccggctttgaccagcgccccgtcaaaccctgacggggacagcggtgccagcaggcggtcatagcagtcaagccgctccagcgccgcggactcccgccgacaggactgcatggcctgtaacgtggctgtcgcatccggcggggtcgtggtggcgacggcgaccgccacaccggccattgacgatgcttctgcgggcgcggcagtggcgggtaagcccgtcatcaggcccgcgataaaccatcctgtctgccggaaaacgcgcaacctgctcataaaaccgtttcatcctttgtgacggactcgtcgttctgagcatcttccacgtctgccgtaaatgcgccgtccactgccgacaaccgaatccgggcaaccgccgtattcgccgccattttctgcaacagcagcagggagagcggcggcagcatattgccgtcgatgaccgattccagcatcctcgcgccgttttccgcgcgggtgacgcggctcatgatttcgtccgtcacttccggttctataatcacctccgcgccaaagcggctgcgcagcacgttatccaggcgggccagtttcccggcaatgatggtggcgagcgtctctttcgacagcggcaggtacggcaccacttccatacgcgccagcagggcaggtttgaagaagtcggccagcaccggatacagtacttcctgcatggtttccgggtcatcggcatgctcgactattacctggtagccgaggttggacgtcaggaagaagacgatatttttgcagtcaatcaggcggccttcaccgtctgccatttcgcccttatcgaacgcctggtagaacaggttgagcacatccgggtgcgctttttccacttcatcgagcagtactaccgagtagggtttctggcgaatcgcttcggtcagtacgccgccttcaccgtagccaacgtagcccggaggcgaaccaatcagtcgcgagacggtatgtttctcctggaactcggacatattgatggtggtcaggtactggcgaccgccgtagagcagctctgccagttgcaggacggtttcagttttacccacgccgctggggccagccagcaggaacgcgcccagcgggcgtcccggacggcgcaggtcggcgcgtgcggtcagcaggtgtttgtgcaggctggcaatcgccaggtcctggcctttgatggtgtcgccgagccattttggcaggtcggtgatgaccgacatttcattctgcgacaggcggttaagcggcacgccggtccattcggcaatcaccgccgcaatctgttttttatcgacgtgcggggaaaccagcaaccggtcgttatgcagggcgtccagttcggcagtgagatgtgccagacgttgtaccggggaaactgtttcagcggtctctttcggctgttcgctgccagcttcatcagccggttcggcaccggtattatcctgctctgactctgactctgactctggctgcgtatcctccacggtatctgcgtccggcaacggcgccgcatcgtcctctgccacgcccagtaactgctggcgcagcgcaataatctcccggaccagcgtctgctgctggtgccaggccgcttccagttcatccagcgccgtcagcgtttcatcatactgcaccagcacctcggtcatccgtgatgtgtcggtacgcagtccgatgcgaagctcgcgctcaagctggcgaatttccgcctcctgctggtggctcagagtggtcagcgccgagatttgcttcggcggcgacgacaggttgatggccacacgggcgcaggcggtatccagcacatcaatcgctttgtccggtaactgacgcccggagagataacgctcgcttaatgtcgcagcggcctgcaaggcgtcatcatcaatcagcacgccgtgagactgttcatagaccgccgacagaccgcgcagaataatggtggcttcggcagcgttgggttcgctgaccttcaccaactggaagcggcgcgacagggcggcatctttttcgaagtattttttgtactcgctccaggtggtggcggcgatggttttcagctcgccgcgcgccagcgccggtttgagcaggttggagatatccagcccgccctgctggttgcccgcgccaatcagggtatgtgcttcgtcgataaacagaatgaccggcaccggggaggaaatgacctccgccatcagccctttgaaacgtttttcgaattcacccttcaccgacgctccggcctgcaatgcgcccaagtcaagggtcatgatatcggtgtttttcagcttgtccggcacatggcctgccacgatgcgcagcgccagcccttcgattaaggcgcttttacccacgcctgcttcgcccaccaccaccgggttgttcttgcggcggcggcagagaatgtcgatcatcaggtcgatttcgtggtcgcggcacagtaccgggtcaagcctgccgttacgggcgtctgcggtcatgtttttggcgtagcgggcaagcagggtgtcagcagcgtccgtcagtgtgcctgcgcctttaccgtctgcatccggcacgactgattccgccgactcctgtgtccattgcacaaagtcctgttgcagacggtcacggttaatgccggtcaacagccgggcggcagcaggcggtatataacgcagcggcgaatgcagcagggccagcagcaacacgccgccacgcaattcgctgtgctgcatctcagccgacgccagcagccagccctctttcagccactcaaccagcatcggggaaaatgccgggtagctgtccgcagaacgggcagttgtgtagttctccaccgtcagcgcctggcgcaactcttccatgccaatatcgccctggcgggtaataacccgcaggtcactgcgtggcatggcgagcatctgaataagcacatggctgacggtaatttccgctgcctgctggctcatacattcagaggcggccatctccagcgcctggcgggagaacaggttaagccgttttaccagcgtgggaagatcaatctggatcataaacgtccttatcgaagtaatttgtttagctggtgcaggatgtcctgcgtctggctgtccagccgcaacagatagaacaggtaaaacaacgccagcacgacaacgccaccacaaaaaatatgtttaatggtcaggcgactgatgagctgataacgcccgccctgggtttttttgtcctggtgtaacagcgggaaaggggcatcgccgcgtagtttatgcaggacgtggtacaggcggcggtagatctgctcaaattccccctgatcctgtgctgccactttgtagcgcccgcgaaatcccagagaaaaacagagccagagaaattccagcagatcctggtaacgtttgggttcacggatcaggcgctccagcaggatgaaaactttctctccaccccaggcttcgttgtggaaatggaccagcaatgactgcttgatccactcgttcttgttcgaccagccgttaccgagcgccgcttcatcaataaacgtgcagaggatgtagcgaaacgagataatcacgcccggttcgtagccctgctcctgaagcagttgctccacggcctgaacatccgtcaccacctgagcaaaaagatgctccggcatcgtctggctgttcatggttgaaaggcgcattaccataccgagtagcggcgtggccgcgtcgatcatcggattcaggctgttgccacgaagcgcgagatgatagtcgcgctggcttttttcgtcgtatccggtaaatggtggcagagacagtgacccctcatccatcgtcttaccctcttatcgcccacagttgcatgttcagatccgggaaactgccggatacatgcagtgcaacggccccggcggcagccatttctgtccaggcctgtccgctcttgtcgagttcgaaatagctgaacccggaatggtaaggaagctggcggggagccaccatcagggcacgcaatggaatgccgggtatctgcacactgaccatattgcggattttttccggcgaggaaattttcgactgctggataaactggcgctggatctgatcgaccggcatgtttgccgccacagccagcacaaaggtggcagattgcagcagttctgtgtcatggatatcggcctgccagataccgtcacgcagatgcagcggcagattaacggctcttggcgacagtacggtatgcagcgcccgtttgacttccggtaacagcgttttaaatgttttggtcaggtcatgatgatcatacacatcaagcgggcagggcaggcgcgacggctcggtaaaggtcatcagttcacccagcaacccggcaagatcaaggtagaaatcttccgggtggagctgggatcgacgagcgcgatgggtaaaccgggtctggttacggttaagtaactgcaacatcataaattccgccacatccgcgatgccgctctgcgccggagagccaatgcggtttgccagatcgcttgcccgtccgccaatggccccctgtacctctttgagataaacacgcagtttcttactgacctgaatattctggcaggaggggataaaatcgtcatccagcgtcagggagccgtcggcatggcgatcactgatacggcaaagcgggagcgtaatataggcgctcatatcttctgcaccgctcataatgcgcggcgtcagttgtcccagcgtcagtgttcgcgtgtcaccttcttctgaatgcaaatcccggacatcggcataattcagccggtaacgcccgattcgccgcccgtcgctgatttcatttctcacatcactggcgaccggcagagcgaggtagatattgcggcttctctcgtccggaaaatgttgcgggtgcagcggatcgggcagtgcgtcctggtcggggatagaaaagacggtgccgtcgggcagtgtgcctgacgcgctgtcaatcatgatcttaccctgtgccagcagttcattgttgagagtgagttcggtaaatccccaggataaattattcatggcccggaaacgctggttatccaggtagtcgttgtaacgctgctgctgctggaaatggtgtggacgcatcagcatcccttcctgccacatcaccttgttgcgggtggttgccataattattcatcctcttttttcatttcgatgctgctttgacgtacatgcaccagcaggcggtaatggtggccggttccttccaccgtctcgatttgtttccattcagtggcctggtcatcggagaaataggccacgacaccaataaactgcgttttctcatccagctttaccggcggcagggttttgatggtgtccggcaacaggttgaaatcctggtggtcgatatagtttttacccagcacatccggtagcggcgtactggctatctggtcatagtcggctgccagcaattttgagtcgtcagtcaggtacaccagttgcacatccacggcggctgattcaccttccgcattggtattggtgtccggttcggtcagcagggtgacggttatttccgaaggttgctccttcaggctcccgacctggatatccgggtttttgatcacctcactgatttttttcgccgtttcgcagccggttaatatgacgcacatcagcacgcaggccagaaacgccttcctgttcatgcttccggctcccgctgtttttcacgaagcacccggtcatagacttgggcgtagacctcgttaaacagcatctcaaacccctgctggcgatcggaggccagttcttcgtaataatggctgtacatttgccatgctccggcatcatccagcggctggcgcagttcatggctgcggcggtactgcacaaagcggcgcagcagattttgtggtgagaaagcatccagcaggacacgaagcgactccacaatcgctgcccggttagcttcttcgtggtggcggacattgcgcaggctttcactgacggcggcgggagccgccagatgtaccgggcttttaccttcggcaaacattacgtcgagcgcggtggcgtaatccatgttcaggcgcagcgggttatcttccagcgggcgcaaatgtttgtctgagaggctgttacgctgctgctgcaaatcgagcagaccttttattgcggcctgtaacgttcgtccggcctcctccagaaaatcatccgcatcgtcggaattgctcatggtaagcgagccgccaagaccgcgcagtaagggggtgaccgcaaggtggcgttgcgccatttctgccgcagagacgtcgtcattacgatcgccggggctggcataaatgggcggcagatccataaacggagtattgatccccccattacttgccggatcggacagcggtgccgatggccggacagccgcaatgcctgaaagcggatcgcccgtggtaatcaggctttcggactgaagtgcctggagtggatcggcagaaaaaccgtttaccacggtgtctgcaagctggtgccggtgagtcattcccggatagtgtggcgtaccctccgttgatagcagggtatccgtgagcatatcgcgattggtaacgatggtttcgggagtggccatttcctcatcgtaatggggaatatctccccggttcagatgaaccctcaccatcagccgtccgatctggatctcatcgccctggcgcaactgtattaggtctgatgttgctgtgacttttgcctgattcagccacagttgtgccgtctgcgggcgcagacaaaatgtgccatcgtgcaggataacggtaaaagcctgggccggaatgctctgctgacgatcctgtaccgaccagtggcattcggggccatggccgacatttccctgctgtgtgaacagacagcgcgccgcccgtccgctttccagctcactgccgttaatgacctgcaatgaaagcgtctgtagtttctcttccggcatattctgctccgtgattatcataatttacgaccgtaccctgatggtgactgagggtcgttcttccggtgtgccgaggaagctggtccagcccagcagcgcacttttgttatcgcccaggcgcattgcgcccacctgctccggcgccagccccagatgtaagtcccaggcaagctgatcgcgcaggatgaaggacacgaacatcgtcagtggcaggaagttttcgccggacggcagaaaagagaggaactgttttcgggtcaggctggtaatactgagctggaattttccgctgagatcgggcactcgtgtacccagaacaaagttgcccagtaccgatcttcccgccagtttttcgccatttttaagagaatagctccccagactattttgctgatccggttcaatatccaccttgcgacgttgccagttttgcagcgtcacttctgacaaatcaaagcagtgggacaccaggccacagattatttccggggatcgtcccggatttgccaggatcccggaatacgccagcattttgctgtgattaatcgccagcttatcgcgaagctggcggtggcccagcccgacaagggagtacatgcgctgcgagaacgcatccacaccgccgttacgaaaactgatgtgatagcggtacttacgccagatatgccagacaaactgggtcaggcggtggctgaacatatccagaaaatcacctaccggactttgttcatgtaccgctttccaggccaggtgatcgaggtaataaccggggagaggcgactggctcccctgtaaccccataaaggtggtggtcatcctgaatgcccctgatgtatcccgtttcagcgcactgatatcactgcacgggaaggcaaggctggcatcggcgctgaaacgcagggtttcctgtgccggatcgtcacgcagggataattctggcgtccccttttcaccctttgccaggcggtgcaacagctccgccatcgcaaaaaaattgtaagagcaggcattatggaaaacctgtgccagcggatcattctgctctttatctgccgggggatttcccggactcagataagaggatgctgcccgattctttccgtccatttccatgtctcctggctttctgtgttcacaacggtcagcatgtggaatgagttaacgctggcgtacagcgacagaaaatgcgaaagcaccgtaccgagcagatacatttccccttcacagacaaacggctccgggtgcagatacagcgtggaggccagtccccggacgggaatacccgtaaacaggcgatcaacggggcgggtctccagacgctcaatggcatccagcttttgttgtgacagccgtgccgtctgcggatgatggattgcgtggcgatcaaagttggcgatgacctgcttcagcgcgtccgtatccagtaatgacagataattcaggttcatggcggagagtagggaccagtgcaggctgccatcaatgaccggccagagtggttgcgtcgggcgggtaatgttgcgaaatgaagcaacagctgcatttttaccggttgtgccggtgatatcgccggaacgaatttgtgacggaagctcacggttggtacaggtcagcgataccgaaaccacttcattactgagcagagattcgtctgacggataactgccatcagcatgtataaaggcaagggtatgatcaaagccgcgatggaacagggatgttttggtccggtgatgccagtacaccacttcccgcttccggctgtattccatctgatggctgaaactttcaaaggctggccactggcgcgcggcctgcgtcgaaacaggacgccccagatcttttttcctgaacatatcctggacctggctcaccacactgttaacggaaaatacatcgtaatgttgtgggtaatggcggctgggaaccagcggatagtctgcccgccggttgtccagcgtgatggcttctgcatggtggataaataaattaatggcaggtgcgcaatacaggcgcagggaatcgcggcgcagccggatgtccacgggcaaagggcgcgaaaaacgcagttgcagggtaaagaattccgcctgcaatccgtcaggcaaagccggacaaccacaaagatcaaaaaagagaaacgcatcggggtaacagaaatactcctgaaggatccggtagccgctgtggacgtttttcggccagggcagcatggcatcctgcggctcaaaaccgacagcttttagcataaactcaggcaggcgaatatgctgttcacccacagtcaggtcggcaccctgcaagtattcgcagaaccataaataaagctggtcacgggtatagttgtcgtcattgccgagccagaagcgaagtttgttcagatccagcgtgcggaagtccgttcccggtgcgaccgaaaaggtgatgttgataacaccattacgggtcgtactgcggttttcaatctgctccaggcgaacgggcagcagccagatatcccggcagagagtgaaggtacagggaggcggctcctcctttttagcatcagagggcagcacttcatcaactctgatttccccggcgttggttgtaaactgctcattacgggggattaacaccggtacagaagacttatccatatccggcgtatattcaataagggtcattgccggaaccggacgcaggtaattaggccatagcatcttaataagcccgtgcgtcagttctgggaattcatcctcaattttctggcggagattgccggtaagaaaagccaccccttccagcaggcgttcaatatccggatccgcatctttttcggccaggaagcgggccagatggggtttttccgttgccagcagcttgctaagctggcgcaggtaatcgagttcttcccggaaatagcgttcttcaaattccatttgtcagtccacccggtaatgctggctgccattcggtgccatatcaaattcaagcacctcatgcgtttcgttaaatgtcacccaggctgtaatatgaaacgtcatatccagcgggctggaggcggatgaaaccactgcctgcacttcagcgtgtgagatccggggttcatagcgttctatacattgctcgatggcccgactcatggattcgcggaagttttcagccccttccggttcatcaatgcccagctcaggcgcaccccggcaactaccggaccgggtattaagaatgtttcgtaggttctggcgaatggattgcctgagcgaatgaatactgcctccctgccggtttctggccgaagaggcttccatacgctcaaaaagagaacctgtggttctttcccgatccggtatcatggtgtgttactccctgtctaaccggccaaccagggaaagctcaaaatttgcccccataaatttaaaatgaggcctcacgcttagcgcaacctggtaccagccgggttcgccttctacatccataacctcaactttggcagcgcgcagaggtttgcggctgcgcacgtctgcaggcgggttttcctggtcggcaacatactgacggatccaggtattaagctctctttctaagtcgctcctttctttccatgaccccagttgttcacgctgcaacaccttgatgtagtgcgctaaccgattgatgatgaagagataaggaagctgcgtacccagcttatagttggtttctgcatcttttcccggaaagtgcttcggtttttgtaccgagtttgcagagaaaaaggctgcattatcagagtctttacgcatggtaagggtgataaaaccctcttcagccagttcaaattcgcggcgatcggtgaccagcacctcggttgggattttggcctgaatctgccccatcgtttcgaacagatgcaccggcagatctttcactgcgccgccgctttgcggaccgataatgtttggacaccagcggtatttggcaaaactgtctgcgatattgcatgccagcatccaggccgtattaccccacagataatcttcgtggttctggctgacatcttcgtaatagttaaagttcttaacagggttatctgttggtgaatagggctggcgaagcaggaagcggggtgccgtaagccctaaatagcgcgaatcttccgagtcacgcagggcgcgccatttggtgtaggccggaccttcaaagatggcataaagatctttgatattaggcagttcggtccacgagttcagccccataaactccggggaaacggaggacaggaacggtgcgtgcgccattgcgcccacggcactgacgtattgcagcagtttcatgtcaggcgcggtatttttgaactcataagcgcccagcacggcagcgatgggttcaccgccaaactgtccgaaaccggacgaataaacgtgcttataaaatccggactgaataatttctggcgcaaactcaaagtcttccagaagttcctgcttggtgacatgaagcacgttgaccttgatgttttcacggaaatcaacgcgatccaccatggttttcagtgagcgccagaacgattcgacctgctgaaaggcaggcgcatggatgatgacatccatctggcggctgatgcgttcatcaatatctgcaatcatgctgtccacggccagtttattgaccggttcggcagatgcagtggattgcaggatgctggcaataaaggctgtcacaccctggcgggcaacgtcataaccttccgaaccgggctgaatacgggtctgtgccatgatttgatcaagcagcgacgatgcctgctcaggctgcccggcatgactggaaacgagttcctcttcctgtaaagacatactgaaaatccttctgttttagctgtgtttctgaaaccggcttttcgccatcagtgaagtacgcgctgccagtgcgacgcgctctgctgaaactcacaaaaatggataatctcatccaatagatcactgatacggcgatccagtgttgtaatcagcgcagccacaccatcctggttgatttcaacggacgggctgaaacatacctggtaaaccacctgcagaatgtctgcaacagagaggtggtatgtcccggagatatttttgtgtgccgtcatgcctggataaccctgtttaatgaaatagtggtggttatttattgctcaccagaccgatttctttgagcaactgctcgcgggactcttcattttccagcaatgcctggagctgggtacggaatgccggaaggttacccatcggccccttcagtgcagtcagtgcttcacgcagttccagcaatttattcacttccggaacctgccgggccacgctatctggtgaaaaatcatccagtgatttgatattcagcgccacattcagttcatcgtctgttgtgcttcccttcagcgtggcggggacagtaaaattgaggccaatggctgcttcagccatcactgcaccgaaattgtgcttgttaacggaaactgcctgacgttcatccagtggggatgtttcctgcgtatttccggtatcgccgacaacgagcatgttaagcggaagttccacttcagccgtctggccatctgtttttgggacatacgatatattaatacgctcgcgaggcgcgacgctgccttcaaattttttgctcataaaagtgatccgtcatgttatctcgtacaggccatgaacacggcatatttgtaccgcaaaaaaatatcggcaatgccgccctaatggcggtgaaaataaaatcaccactccttcatcaccccgcattttacgcttcaaaataaataagaaaaggactttttatcgatcataaagaggggtattctgcaagcgttaaatagattgtgtgaacctgtgcaattcgcgtcaggtgtattatggcaataatttaaatatagattttttatgtaacttattgaagtatataataatttcattaaacataagctaatctaatgattgcttatttatatatttgttttgtgattgattaagtgggtatttttaaggaatatctcaaaaattatcaaaatgataattcagaaaggataaatacaatatttattcatgattcagctttggccattttatggaggcaatacggactttgaacagttgggtatggttatccagatatatattattaagttattgctgaataagagatttaatgattttaaaaatagtttttacgacaaccgtaaattctagctcggtttgtatgtaaaaaatactgaaaaatgatgcggttccgtgaagtgagctgcatctgcctgtctgggattaacggcaggtcattgtaagtagtaattaaccacgttaacaaggagtttacaaatgccaacaccgtgttatatctccatcactggtcagacccagggaaatattactgcaggtgcatttaccgctgattctgtcggcaacatctatgtgcaggggcacgaagacgagatgctggtgcaggaattcctgcataacgttactgtcccgaccgatcctcagtccggtcagcctgcgggtcagcgtgctcacaagcctttcatttttaccgtggcgctgaacaaagcggttccgctgatgtacaacgcactggcctccggcgaaatgctgccaaccactgaacttcactggtggcgtacctctgtggaaggcaaacaggagcattatttcactacccgcctgactgattcgacgattgtcgatatgaaactgcatatgccgcattgccaggacccggcgaaacgcgagttcacccagttgctcgaagtttcactggcctaccgcaaaattgaatgggaacacgtcaaatctggcacctccggtgccgacgactggcgcgcaccgctggaagcataagttaagccaacagcatccggctatcaggccggatgctgtttttgtattacgccgtagaaagaaaggttgtcagtaaggggttacgttcacgggagatggcggctgccggaaacttcggcggtagcgtgcctgaacgcaagcgtaacactgtactgtcacagccgctttaacagcgaactgtctgtttttccttaaccccggaggttgctatgtcaaccggattacgtttcacgctggaagtggacggcctgccaccggatgcttttgcggtggtctcctttcatctgaaccagtcactctcttcgcttttttccctcgatctctctctggtcagccagcagtttctctcccttgaattccagcagatcctcgacaaaatggcctacctgacgatatggcagggcgatgacgtacagcgccgggtgaaaggtatggtgacctggtttgaactgggggagaacgacaaaaaccagatgctgtacagcatgaaggtgtgcccaccgctgtggcgcacagggctgcgccagaacttccgtatcttccagaatgaggacatcgaaagcatcctcggcacgatattgcaggaaaacggggtgaccgagtggagcccgatgttcagcgagccacatccttcccgtgagttttgtgtccagtacggtgagactgattacgatttcctgtgccggatggcggcggaggaaggcatcttcttttatgaggagcacgcgcaaaaaagtaccgaccagagcctggtcctgtgcgataccgtgcgttatctgccggagtcctttgagatcccctggaatccgaacacccgtaccgaggtgagcaccctctgcatcagccagtttcgctacagcgcacaaatccgcccttcttccgtggtgaccaaagactacacctttaaacgacccggctgggcagggcgttttgatcaggaaggccagtaccaggattaccagcgcacacagtatgaagtgtatgactaccccggacgtttcaagggtgcccacgggcagaactttgcccgctggcagatggatggctggcgcaacaacgcagaagtggcgcgcggaacaagccgttcgccggagatatggccgggacggcgaattgtgctgacggggcatccgcaggcgaacctgaaccgggaatggcaggtggtggcgagcgatcttcacggcgaacagccgcaggcggtaccgggacgcaggggttcaggcaccacgctggataaccactttgcggtaatcccggcagaccggacatggcggccacagccgttgctgaaaccgctggtggacggcccgcagagcgccgtcgtgacgggaccggcaggcgaggaaatcttctgtgatgaacatggccgcgtgcgggtgaaatttaactgggaccgctataacccgtcaaaccaggaaagttcatgctggatccgtgtggcacaggcgtgggcaggcaccggctttggtaacctggcgataccgcgtgtgggtcaggaggtcattgtggacttcctcaacggcgatccggaccagccgatcattatggggcgtacctaccaccaggaaaaccgcacccccggcagcctgccggggacgaagacgcagatgacgatccgctcgaaaacctataagggcagcgggtttaatgaactgaagtttgacgatgcgacagggaaagaacaggtctacatccacgcgcagaagaacatgaacaccgaggtgctgaataaccgcaccactgatgtgataaacaaccatgccgaaaaaataggtaacaaccaggcgatcaccgttaccaataaccagatccagaacattggcgttaatcagatacagacggttggtgtcaaccaggtggaaacggtgggcagtaaccagattatcaaagtgggatcaaaccaggttgaaaaggtggggatcattcgtgcgctgacggtgggtgtggcttaccagacgacggtaggcggcattatgaatacctcggtggcgttgttgcagtcctcacaggtagggctgcataaatcactgatggtgggaatgggctacagcgtcaatgtggggaataacgtcaccttctcggtgggcaagacaatgaaggaaaacaccggacaaacagcagtttattctgccggtgagcatcttgaactctgctgtggtaaggcaaggctggtgctgacgaaggacggaagcatatttctcaatggtacgcacattcatctggaaggggagtcggatgtgaacggtgatgcgccagtgattaactggaactgtggtgccacacaacctgtaccggatgcgcctgtgccgaaagatttaccccccggaatgccggatatgcggcaattttgagtcaggtgcaaaaaattaaaacggaactggtgcagtgaccagataaaccatattaaaagcagaaggaattgattcatgggcggaaaaccggcggcgcggcagggtgatatgacccgcaagggactggatattgtgcagggttcagcgggggtgctgataggtgcgccgacgggagtggcctgttcggtatgtccgggagggattacctatgctaacccggtgaacccgctgctgggtgcgaaggtgctgccgggcgagacggaccttgcgctgcccggcccgctgccgtttattctttcccgcgcctacagcagctaccggaccagaacacccgcgccggtgggggtgtttggtcccggctggaaagcgcccttcgatatccgcttacagatacgcgatgaaggcctgatactcaacgacagcggcggcaggagcattcactttgagccgctgtttcccggcgagataagctacagccgcagcgagtcactctggctggcgcggggcggagtagcggcgcagcacagttcgcagccgctaagcgcgctctggcaggtgctgccggaagatgttcgcctgagtccgcatgtgtacctggcgacaaacagccttcaggggccgtggtggatactcagctggccggagcgggtgccgggggcggacgaggtgctgccgccggagccgcccgcataccgggtgctgacgggcgtggtggacggcttcgggcggacgctggcctttcaccgggcggcggagggtgatgtggcgggcgcggtgacgggggtgacggacggcgcgggccgccgttttcacctggtgctgaccacacaggcacagcgggcggaagtattccgtaaacagcgcgccacgtctttatcttcccctgccggtccccgttctgcttcctcttctctggttttccccgacacgctgcccgccggtacaggatacggcacggataacggtatccggctggaggcggtatggctgacacacgacccggcatacccggatgaacagccgactgcgccgctggcgcgctacacgtacacggccggtggtgaactgcgggcggtgtatgaccgcagcggaacgcaggtgcgcgggtttacttatgatgcggagcacgccgggcggatggtggcgcaccattatgcggggaggccggagagctgctaccggtatgatgataccggtcgggtgacggagcaggtcaacccggaggggctggactaccgctttgagtacggagagagccgggtaatcatcacggacagcctgaaccggcgggaggtgctgtacacggaaggcgagggtggcctgaagcgggtggtgaagaaggaacatgcggacgggagcattacccgcagcgagtatgatgaggcggggaggctgaaggcacagacggatgcggcggggcggcggacggagtacagcctgcatatggcgtcgggtgcggtgacggcggtgacggggccggacggcaggacggtacggtatggctataacagccagcggcaggtgacgtcggtgacgtacccggacgggcttcgcagcagccgggagtatgatgagaagggaaggctgacggcggagacctcgcgcagcggtgagacaacgcggtacagctatgatgacccggcgagtgagctgccgacagggatacaggacgcgacgggcagtacaaaacagatggcatggagccgttacggtcaactgctggccttcacggactgctcggggtacacgacgcggtatgagtacgaccggtacggtcaacaaatcgccgttcaccgggaggaaggcatcagcacttacagcagttataacccgcgtgggcaactggtcagtcagaaggatgcgcaggggcgtgaaatccgttatgagtacagcgccgcaggcgacctgacagcaacgatatcaccggacggtaaacgcagcaccatcgaatatgataaacgcgggcgtccggtgagtgtgacggaaggcggtcttacgcgcagcatggggtatgacgctgccgggcgcatcaccgtgctgaccaacgagaacggcagccagtccacgttccggtatgacccggtggacaggctgactgaacagcgcggttttgacggccggacgcaacgttaccactatgacctgaccggaaaactcacgcagagtgaagacgaggggcttatcaccctctggcactacgatgcgtcggaccgcatcacgcaccggacggtgaacggcgacccggcagagcagtggcagtatgatgagcacgggtggttaaccaccctcagccatacctgtgaaggccaccgcgtgtcggtccactacggctatgacgataaaggccgcctgacgggtgaacggcagacggtggagaacccggagacaggggagatgctgtgggagcatgagacggggcatgcgtacagcgaacaggggctggcgacccgtcaggagccggacggtctgccgccggtggagtggctgacgtatggcagcggttatcttgcggggatgaagctgggcggaacgccgctggtcgagtacacgcgggaccggctgcaccgcgagacggcccgtagcttcggcggggcgggcagtacagcggggtacgaacaggccacggcgtacaccctcacagggcagctacagagcaggcacctgaaccttccgcagcttgactgtgactatacgtggaacgataacggacaactggtgcgcatcagcggcccgcaggagtgccgggagtaccgttacagcggcacgggaaggctgacgggcgtccacactacggcagcgaacctggatatcgatatcccgtatgcgacggacccggcaggaaaccggctgccggacccggaactgcacccggacagcaccctcacggcgtggccggataaccgcatcgcggaagatgcgcactatgtctaccgctacgatgaatacggcaggctggcggagaagacggaccgcatcccggaaggggtgatacggatgcacgacgagcggacccaccactaccactacgacagccagcaccgtctggtgttctacacgcggatacagcacggtgagccgcaggtggagagccgctacctctatgacccgctgggccgccggacgggaaaacgggtgtggcggcgggagcgtgacctgacggggtggatgtcgctgtcgcgtaaaccggaggagacctggtacgggtgggacggtgacaggctgaccactgtacagacccaacagacaagaatccagacggtataccagccgggaagcttcacgccgctcctgagaatcgaaacagagaatggtgaacaggcgaaggcgcggcaccgtagcctggcggaggtgttgcaggaggacacgggtgtgacgctaccggcggagctggcggtgatgctggggaggctggagcgggaactgcggcagggcagcgtgagtgaagaaagccagcagtggcttgcgcagtgcgggctgacggcggaacagatggccgcgcaactggaggcggaatacatcccggagaggaaacttcatctttaccactgtgaccaccgtgggctgccgctggcgcttatcagcccggaaggggaaacggcgtggcagggggagtatgacgagtggggaaacctgctgggcgaggaaagcgcgcagcaccttcagcagtcactccgtctgccgggacagcagtatgatgaggagtcggggctgtactacaaccgcaaccggtactatgatccgttgcaggggagatatatcacccaggacccgatagggctgagaggtgaatggaatctgtataaatatccattaaaccctgttcggtttatagattctttgggtttaaaattccatgttaacggtgatccaagtgattttaatcaggctgttgagtatttaaaacaagattcacaaatgaaagaaactatagattttttatcaagctctgaagaaactataaatatagagtatattgaaggaaccaatgttagatttaattcgaataatatggcgatatattggaatagtagagcatctttattttgttcaactgaattaaactcgaaatcacaatcgcctgcattaggtttgggacatgagtttgctcatgcgcagtattaccttcttgataaggaaaatttcatggctcttttaagccgaacagataagaaatatgagaataaagaagaggcaagggttattacaataattgaatcgcgtgcggcgaaaactttaggtgagtgtaccagaggagctcatagtggactgcctttttatcgggtggatggaccgttgcagacgatgaaaataacgggtacgccagaatagtgaggttttttatgatgaaatatttgatggttttattgtctctattttctggttcggtactggggatggggcgagtgaatgaattgtgtggaatagatagcgtgaaaacgatagagataattaatcttccatcgtatgttaccacgttagttccgcttagcaaggaaggtcttaatgaaatatacagatataaagtggtggtgaatgaaattagcgatctttatgctggtaagataattgatttattgcaaatgaagtatttcagaaaagaaaaatataacaatataagatggggggttagtatcatttcgaaaggtaataataaatgtgaaatttattttgatgcttttggtgaatgtggaagtgtgaatggcattaacgtgtgttttgaaaaaaatgaaatgataggttggattaaaaaagaaatccctttgctgtcgcaaaaaataggtgggctttaaatggtagggcaatattcaaagacagtataggtaactatttgtatggccatgtaaggtaaaagaaaaggaataaaccatgagcggaaaaccggcggcgcggcagggcgacatgacccgcagggaaagatcatcagaagttcactttttgtactaaataattcgcattttatgtttaaaaattgagatattcctcattacctgaagctgttttttattgcttatacatgatcaaatactccttacataaataaggtgaacaaatggaacttaaaaaattgatggaacatatttctattattcccgattacagataagcctggaaagtagagcataaattgtcaggcatcctactattgactatttttgccgttatttctggtgcagaaagttgggaagatatagaggatttcggggaaacacatctcgatttcttgaagcaatatggtgattttgaaaatggtattcctgttcacgatactattgccagagttgtatcctgtatcagtcctgcaaaatttcatgagtgctttattaactggatgcgtgactgccattcttcagatgataaagacgtcatcgcaattgatggaaaaacgctccggcactcttatgacaagagtcgccgcaggggagcgattcatgtcattagtgcgttctcaacaatgcacagtctggtcatcggacagatcaggacggatgagaaatctaatgagattacagctatcccagaacttcttaacatgctggatattaaaggaaaaatcatcacaactgatgcgatgggttgccagaaagatattgcagagaagatacaaaaacagggaggtgattatttattcgcggtaaaaggaaaccaggggcggctaaataaagcctttgaggaaaaatttccgctgaaagaattaaataatccagagcatgacagttacgcaatgagtgaaaagagtcacggcagagaagaaatccgtcttcatattgtttgcgatgtccctgatgaacttattgatttcacgtttgaatggaaaggactgaagaaattatgcgtggcagtctcctttcggtcaataatagcagaacaaaagaaagagccagaaatgacggtcagatattatatcagttctgctgatttaaccgcagaaaagttcgccacagcaatccgaaaccactggcacgtggagaataagctgcactggcgtctggacgtggtaatgaatgaagacgactgcaaaataagaagaggaaacgccgcagaattattttcagggatacggcacatcgctattaatattttgacgaatgataaggtattcaaggcagggttaagacgtaagatgcgaaaagcagctatggacagaaactatctggcgtcagtccttgcggagagcgggctttcgtagtcttaccccgactctcccccagccttaaacacaacccccactcaccgcaacctaaactcatccgcatcctgccatgccggaaacttttctctatattcccgcaatgccaccatcgacagctccgcatcaatgcgcgttgcctgatgcgcgtcggcagtagcgataatctcgccctgcgggttaatcacccggctgtcaccgcgataatggcagccgttgccatcgctgccgacgcgattgcatcccgccacatacgcctgattctcaatcgcgcgggccgtcagcaatgcctgccagtgcagagagcgcggagcaggccagttggcaacgtagatggcgaggtcataatcgttgagattgcgcgaccacacaggaaaacgtaagtcgtagcacaccagcggcaaaatacgccagccgcgccattccacaatcactcgcgcattgcccgctttataatgcagatgctcatctgccatgcggaacagatgacgcttatcataaaaatgtaccgtgccgcccggctcaaccagcaaaaagcggttaaccgaaccagactccgtttgtaatgcaacactgcctgcaatcagcacattgcactgctgcgctttagctgtcatccagttcactacgtcattttgtgctagcgacgaagctgccgcttccatggcaaagccgctggtaaacatctccggtagaacgatcacatcgcgcccggtaataccttccagttgacgatcaaaatgacgcaggttggcagggccatccatccacaccagtggttgctgcaaaagcgtaatcttcaaaccaggcacggtgtacaactcctttatgcgaagggttttataactttaacaccttatcaggcagttgccttagcgcagaataaattgataacaaatgctgatattggaaatatctgatttgcaaattatcgtgttatcgccaggctttagaaggttaataacatgggcaggataagctcgggaggaatgatgtttaaggcaataacgacagtcgccgctctggtcatcgccaccagtgcaatggcgcaggatgatttaaccattagcagccttgcaaagggcgaaaccaccaaagctgcatttaatcagatggtacaagggcataagctgcctgcctgggtgatgaaaggcggtacttatactcccgcacaaaccgtaacgttgggagatgagacgtatcaggtgatgagcgcgtgcaaaccgcatgactgtggctcgcaacgtatcgctgtgatgtggtccgagaaatctaatcagatgacggggctgttctcgactattgatgagaaaacgtcgcaagagaaactcacctggctgaatgtgaacgatgcgctttcgattgatggtaaaacggtgctgttcgcggcgttgaccggcagcctggaaaaccatccggatggctttaattttaaataattagcggataaagaaacggagcctttcggctccgttattcaattacgcggcttcaactttccgcactttctccggcaactttaccggcttcgtcgccagctcttccggatcaaagtcatcaacgttaatactgcgcagacggctttcttcagctttcaccagaatagcggcttcatctttatcaatcagccccttcgccagcgcgttgtgcgccagttcatccagacgggtaaacggcaggtttttacccagctctttacagatccgctgatgaattgggtcggcggcaatcacatccaccagcgcctcttccagcaagccaaccggattatgctcgctcggcgtcaggtactgaccgcgaccaatgcgggaacgggtggcgttcggcacttgtaaaatcttcgccactttatgatccagcttgtcagaaggtgccagataatgacgtccggtcgggaagatcaccacattcagcagcccggcaaccacgcggttcgggaagttttgcagtaaatcatccatcgcctgttcagcctgatacagcgcatcttgtacgccccagtgcaccagcggcaggtcggcttcattacggccttcgtcgtcataacgcttcagaacggcagaggcgaggtaaagctggcttaaaatatcccccagacgtgccgagatgcgctcacgacgtttcaggctgccgcccagcacagccatcgagacatcagaaagcagggcgaggttggcgctcaggcggttcaggtgctgatagtagcgtttagtggcatcgccggttggcgtgctgctggttaaaccgcgcgtcaggcccagccagaagctgcgaactttgttgctaccgacgtgaccgatatgtttgaacaacagtttatcgaacgcgttgacgtcattgttcttcgctgcttccatctcttccagcacgtacggatggcaacgaatcgctccttgtccgaagatcatcatgctgcgggtcagaatgttggccccttcaacggtgatggcaatcggtgcgccctggtaagcacgcgccaggaagttgctctgcccgagcataatgcctttgccaccagtgatatccatcgcatcaataatcgactgctgcccgcggtgggtacagtgatacttaacgatagccgacagcacggcaggtttttcgccgagcataatgccgtaggtaatcagcgatgccgcagcatccatcacgtaggcattaccggcaatacgcgccagcggctcttcaatcccttccatcttaccgatagagattttgaactgacggcgaatgtgagcatacgcgcccgttgccagcgctaccgatttcacgccgccggttgagttggaaggcagggtgatgccgcggcctaccgagaggcactccaccagcatccgccagccttgcccggccattttcggcccaccgatgatgtaatcgatcggtacgaagacatctttaccgcgcgtcggtccgttctggaacggtacgttcagcgggaagtggcgacgaccaatttccacgcccggcgtggtggtcgggatcagcgcacaggtaatacctaaatcttctgcgccacccagcagcttttccgggtcggagagtttaaacgccagcccaagcacagtcgcaatcggtgccagcgtaatgtagcgtttgttccaggtcagacgcatccccagcacctgctggccctgccattcgcccatgcagacaatcccggtgtccggaatcgcgcccgcatcggaacccgcttccgggctggtcagtgcaaagcaggggatctcctgaccacgcgccagacgcggcagatagtgatctttctgctcgtcagtgccgtaatgttgcaacagttcgcccgggcctaatgagtttggcacgccgacggtaatcgccaggatcccgctcacgccggagagtttttgcagcacgcgagactgggcataagccgagaactccagcccgccgtactcttttttgatgatcatcgcgaagaaacgatgctctttaaggtacgcccacaactccggcggcagatccgccagctcatgggtgatctggaaatcattcgccatccggcaggcttcttctaccgggccgtcgagaaacgcttgctcttcggcggtcaggcgcggctgcggatagttatgcagctttttccagtccggcttgccctggaacaagtcgccctcccaccaggtggtgcccgcatcaatcgcttctttctcagtgcgcgacatcggcggcatcaccttacggaaaccgcgaaataccggcgcggaaatcatcgacttacgcataggcgcaaagttaaatggcacgaggataatggccagaggcaccagtacccacgccgaccacagaccagcaacgccgagggcggctgtccaggcgagcaaaatcagactgctgataaataagctcacgcggtgatagaacaacgcgccgagcaggacaaccgtagcgagaatactcaaaatcatcataacgaaaagccccttacttgtaggaggtctgaccacttgtgatgatatggttgtagtggatgtaaaaacatttagcaatgtgtttacaatataattacaacaaagctcacattgttgctgtttttatccgcacttcaggtcaaaaagtcctggtcatagcacctgcccgtacttctcgcttttggcggtatccggtacactgcattttgtctattacatttatgctgaaggatatcctcatgtaccaggatcttattcgtaacgaactgaacgaagcggcggaaacgctggctaactttttaaaagatgacgccaatattcacgccattcagcgcgcggcggtcctgttagcagacagctttaaagccggtggcaaagtgctttcctgcggcaacggcggttcccattgcgacgctatgcactttgccgaagagttgaccggtcgctaccgtgaaaaccgtccgggctacccggcgattgctatttctgacgttagtcatatttcctgcgtcggtaatgatttcggtttcaatgatattttctcccgctacgttgaagcggtaggtcgcgaaggcgatgtactgctggggatctccacctccggtaactctgcaaacgtgatcaaagcgatcgcagcggcgcgtgagaaggggatgaaagtgatcaccctgaccggtaaagacggcggcaaaatggctggcacggcggatatcgaaattcgcgtaccgcactttggttatgccgaccgcattcaggagattcacattaaagtgatccatatcctgatccagttgattgaaaaagagatggttaagtaagtctggcgtaggccggataagacgtttacgccgcatccggcaattgtgcaccgatgcctgatgcgacgctgacgcgtcttatcatgcctacaaatctgtacgcgaaccgtaggccgaataatgcgttcacgccgcatccgacctgaaaattcttaaatcaatcttcgccgggggccatgcgctcccgctgttgtggaggttacccatgtgcgaattgctcgggatgagcgccaacgtccctaccgatatctgctttagtttcaccgggcttgtacagcgtggtggtggaaccgggccacataaagatggctggggcattaccttttacgaaggtaaaggctgtcgcacatttaaagatccacaacccagctttaattcccccatcgccaaacttgtccaggactacccgataaaatcctgttcggtggtggctcatattcgccaggctaatcggggcgaggtggcgctggaaaatactcacccatttacccgcgagttatgggggcgtaactggacttatgcccataacggacaactgacgggctacaaatcactggaaaccggcaacttccgcccggtaggcgaaaccgacagcgaaaaagccttttgctggctcctgcataaattaacgcagcgttacccgcgcacaccgggcaacatggcggcggtatttaaatatatcgcctcactggcggatgaactgcggcagaagggcgttttcaacatgctgctttctgacgggcgctatgtaatggcgtattgctcgactaatttacactggatcacccgccgcgcgccgtttggcgtggcaacgttgctggatcaggatgtggaaatcgacttcagctcgcagaccacaccgaatgatgtggtcacggtgattgcgacacagccgctgacgggcaatgaaacctggcaaaaaattatgccaggcgaatggcgcttattttgcctcggggagcgtgtagtttgatgccagctgtggttgcacaacttcgtggcttaacggcttgctgaccacgtaacgaccattgaccacagaaacggtcggtggcttacgggtttgctcaaagtagtcgtaacccggcttcagttgctcccagaagtccttaaagttggaatatttgtggcgcttcatattagcgtcggtcatgcggaacgggtaaatgctcacttgcacgctcggctgaccaaataccagtgcgccagtaacgaactggaaaatctcgtcaatgccctgattggtcatcgcgtagcagccgatggaaacacaatcgccgtggatcatcaggtatttcccttcataaccatgcgcacggtcataggcattggggaaaccaatattaatcgctttgtagtaacggctgtctggttttaactgattacgctggacgctataaaacccttccgggcttttgaaatcgccctgacgctgttttggccctaagccgccggaatatttacagattttataactgtcgagcagctgatattgctcgcccattttgacgtagagatcgagcgtacgttcttccttgaagatctggatgtagacaggggatcccatcaactgctgcttatactctttgctcactggcgtggtcgagctactgctgcccagcaaaccggcaaacgaaacgcacgggatcaacaacatcgcaagaattaatgcgattttacgcatactgcttattccttgataaaacggttacacacgccaggacggcaaaatggatcccaaatcggaatagtctggatttggaaggctcacattatcaccaaaagagttttacgcaagcctgtcggcgcagggtttacaaatttcatcggcagcgtgctttacccaaagagcgccgcgtgagttccagttctctcaaatcgtaaaagtttatcggtaagtttgtaaatcaggatccagtccggttcgacatgagcatcgcgataacctttccatgaaccttgcagcgggtggtctttataaacagctggaagcggtaaagcattattgataagaagcgtcataagatatttcaatttattcatatccttatgacgcttttgtgcaagttttacatcctttgaaaattgtcccgagtattcaatatccctttgaatcatatttaaattcctaatttatcaaataaatcatcggcgtctttggccttatgaacatcaacgccagcttcgctgtttttgattgattgaatggttaattgattaggctcgcgtaaatcaaacggcaatgccttttcacgcgcgacctttgtgagggttatgcgaaccaggtcagagatggtcagccccatcccggccagtacgtccgccgcctgattcttcagatcttcatcgattcgggcgcgaacaaatgcgttagcagccattggggtatctcctgtgctgtatatttattcagcttgaattgtagctcaaatgagcaacagcgacaatccatgagtaatttaataaacggatgtttttacataattaactgaaatatatttattaattttataataatggtttattaagtttgttcaggtacgggccgggatacactgcaacatcaatgcatgatcagccattattgagtatgtccttgccgtcgattccctcttttgtgttgtcgggattactgttgctttgcttgccgttttcttcatttgccagcgccaccacatcacatatcactttcagctacgccgcccgccagcggatgcaaaatcgtgcgcgtttattaaaacagtaccaaacccatctgaaaaaacaggccagctatattgtggaaggcaatgccgaaagcagaagggcgctacgccagcacaaccgcgaacagataaaacagcatccagaatggtttcctgcgccgctcaaggcgagtgacagacgctggcaggcgctggcggaaaacaaccatttcttaagcagcgaccatctgcataacatcaccgaagtggcgattcaccgtctggagcaacagcttggcaagccttacgtctggggcggtacgcggcccgatcaaggcttcgactgtagcgggttagttttttatgcctacaacaagatccttgaggcgaaactcccacgcacggctaatgagatgtatcactatcgccgggcaaccattgtggcgaataacgacctgcgccggggagatttgctatttttccatatccacagccgcgagattgccgaccatatgggggtgtatctgggcgacggtcagtttattgagtcaccgcgcaccggggaaaccattcgggtaagtcagttagctgaacctttctggcaggatcactttttaggcgcgcggcggattttgacggaggagacgattttgtaaatgggtaatattgacgaactggcaaaaggtcggatgccacgcggcatccgacctgtttacatctgggctgaaaactcacgttctaagacatcaacaatgagctggttttttgaaatggaatgttgtctggcgacgatggtcagccgcgaatcaatgtgatgaggaacacgaagcgtcaggcgtttttgctcttcttcttcacgaaaaggggcaataccgtcctcttcacaatccgccatccactcatccagcgcgctttcgccttcacgatataatgcctcaatacttgtggctacaaagtcacaataaccgtttacattgaggaacttgccgcgaaatgcgttgatatcggcttcaaatgttactgcggctggttgacctttaattgtgataatgttcgatgctttattcataatctacccctacacagttaacaaaccactccttaagacctgctactgcgcctttatccatcacattttttggatgtggctcatgtgtgctgaatttggtcgttccaatctgaaattttcgtctggagccgttgttattttttattgttccacccacagctttaatgagtgcaacaacatcatcccatttaattccagattttggcggctccgtcattacatcgtcgaatgtttttctatgacgagaacctagcgcgctgaccttaatcatactatcaatccatgacgtcattgtatggtgtcatcgtagtctctttgcagtgtgacgtcaattaatggtgtcaggtgctgcaaagcatggaaaagaatcccccatcaactcaacgcccccataatcttcaactccagctcatccggcacttcgttatacgacagcacatgcagccccggcgcaaacaaccttgcataacgcgccagcaaagggcgcagctgcggtggcaccagcagcaccgggtctttccccgccgttttcatctgctctttcacctgtggcatcgtactctggaactggttgagcatattcgggtccactggcacgctgtcgagcatcactttaccgccctgttgcgcctgattcactaggttagtcagcagattttccagctcattattcagggtatacaccgtcagctcctgcttgcgaacgaacggatgggtaatgctgcgccgcagcgccaggcgcacatcggctgccagcagaatatgatctttggtcaccgcgctactggcgaccagcacggtggcgatggtgacgatatcgcgcagggaaacgccttcggtcagcagcgcccggtacactttcagcaactggctgtaattgagcaccgcgcttaaatcctccgccaggcgcggtgccatcgacgccaaacggttatgcaactgcgtaatatcgtcatagttaaataaatcaggaatatagctgcgcacaatcttatttacatgggtagcaatcacgctggcgctgtcgatcacctgataccccatattcagcgccttcgctttctgcgcaggctggatccaggtcaccggcatcccgtacgccgggtcgttccccagcacgccgtctatctcgccgtaggtttcgctggagggcagcgccatcagtttatccgccggaatatccgcttcatcagccttaatgccgttgatgaaaatagcgtactggctgggcttaaggcggaagttttcccgaatgcggatctccggcagcagcacgccgttgccgtcggatatcacctgtcgcacgccgcgaatacgctgggtgagcgggttgccctgggctttgtccaccagcgccaccagcttgtagccgaggcttaagctgatgggctcgatcagcggaatggtttcccaactgacctgttgctcgctggtttcggtgatggtgcgggtcagcgtttcgagacttttctcttccgcttccgccgcctgcgggcgtttgctcatccgccagccggtaaagccaagcagggcgctgaacagcaaaaacggcagatgtggcattcccggcactaccgccagtacgaacataattccggtagcggtgtagagcaccgatgggcttgccagcaactggttacgcacgtcatgggcgatatcgccgttgtcgctgacgcgggtgacgataatcgccgccgcggtggagagtagcagggaagggatttgcgccaccagcccgtcgccgatggtcatcagcacatactgctggaaggcggcgtcggcgctcaggttgtatttgaagatcccgatatagacgccgccgatcaggttgatcgccagaatcatcatcccggcgatagcatccccgcgcacaaatttcgatgccccgtccatcgcgccgtagaaatcggcctcgctggcaacatctttacgtcgggtttgtgcctgcgcctgattgatcaacccggcattaagatcggcgtcaatcgccatctgcttaccgggcatcgcgtccagggtaaagcgggcagaaacctcggagatacgctcggcccctttggtgacgacaataaagttgattgtcaacagcgtcagtaaatccgagcgtgaaagcattatcgccgcgctgcacgggcagtcgatttttaacggtggtgggctgtcgccgttaaataaaatcagcccgtctcatccgccaaaacctgccaccgtggcggtgccggaagaaacggagaaaaaagcgcgcgacgtcaatgagaaaacggcgctgctgaagaagaaatccgccaccgagcttggcgagctggcaaccagtatcaccaccattgcccgtgatgcgcatatggaagcgaatctggagatggagattgttccccagggattacgcgtgctgattaaagacgaccagaatcgcaatatgttcgaacgcggcagcgcgcagattatgccgttctttaaaacgctgctggtggagctcgcgccagttttcgactcgctcgataacaaaattattattaccgggcataccgatgcgatggcttacaaaaacaatatctacaacaactggaacctttcgggtgaccgcgcgctttcggctcgtcgggtgctggaagaggccggaatgccggaagataaagtgatgcaggtaagcgcaatggcggaccagatgctgctggattccaaaaatccgcaaagcgcgggcaaccggcgcattgagattatggtgctgaccaaaagtgcgtccgatacgctgtatcaatactttggtcagcatggggataaagtggtgcagccgctggtgcaaaagctggataagcagcaggtgctttcgcagcgaacgcgttaaatgctgaatctttacgcatttctcaaactctgaaatcactgtatactttaccagtgttgagaggtgagcaatgcgtaaaatcattcatgtggatatggactgctttttcgcagcggtggagatgcgcgacaatcccgccctgcgcgatatccctattgctattggcggcagccgcgaacgtcggggggtgatcagcaccgccaattatcccgcgcgtaaatttggcgtacgtagcgctatgccgacagggatggcgctcaaattatgcccgcatctcaccttgcttccggggcgctttgacgcctacaaagaagcctcaaatcatatccgtgaaatcttctcgcgctacacctcgcgtattgaaccgttgtcactggatgaggcttatctcgacgtcaccgatagcgtccattgccacggttctgcgaccctcatcgcccaggaaatccgccagacgattttcagcgagctgcaactgacagcgtctgcgggcgtggcaccagtaaagtttctcgccaaaatcgcctccgacatgaataaacccaacggtcagtttgtgattacgccggcagaagttccggcatttttacaaaccttaccgctggcaaaaatccccggcgtcggcaaagtctcggcggcaaaactggaagcgatggggctgcggacctgcggtgatgtacaaaagtgtgatctggtgatactgcttaaacgctttggcaaatttggccgcattttgtgggagcgtagtcaggggattgacgagcgcgacgttaacagcgaacggttgcgaaaatccgtcggcgtggaacgcacgatggcggaagatatccaccactggtctgaatgtgaagcgattatcgagcggctgtatccggaacttgaacgccgtctggcaaaggtaaaacctgatttactgattgcccgccagggggtgaaattaaagttcgacgattttcagcaaaccactcaggagcacgtctggccgcggctgaataaagctgacttaatcgccaccgcgcgtaaaacctgggatgaacgccgcggcgggcgcggtgtgcgactggtggggctgcatgtgacgttgcttgacccgcaaatggaaagacaactggtgctgggattatgaataacatacaaataagagactatcagcctggcgattttcagcaactatgcgctattttcattagagcggttacgatgactgccagtcagcattattcaccacaacaaattgccgcctgggcgcagattgacgaatctcgctggaaggagaaactcgcgaaatcacaagtgcgggttgcagtcattaatgcaaaactggtcggctttattacctgcgttgaacactatatcgatatgttatttgttgaccctgaatacacccgccgtggggttgccagcgctttgttaaaacctttgattaagtctgaatccgaacttacggtggacgcaagcataaccgcaaaacccttttttgaacgttatggttttcagacagttaagcagcaacgcgttgaatgtcggggagagtggtttattaatttttatatgcgttataaacagcaacattaaatccagcttgcaatgaaaataacgcaagcctagtatgtgcgcgttttcttattccacaaactgcaaggaggtaaatcatgacaaatcctttatcaatgactctttgcagacctttccaggattaattctttttttcttgccctggattcgtctgccatttcctgattttttaattgttactctcaataattcaagtcgcaacacatgcaacttgaagtatgacgagtctatttacggaatggtatatgggcaattatattcgtcccttatccgatgcggtatttaccatcgcatctgatgacctgtggatcgagagtttagcgatccaacaattacacaccacggcaaatttacccaacatgcagcgcgtagtggggatgccagatttacatcccggacgcggctatccgattggcgcagcgttcttctctgttggtcgtttttatccggcactggtcggcaatgatatcggctgcggtatggcgctatggcaaacagatattctcactcgcaaatacaacgccgataagtttgaaaagcgattatcagatctggatgacgttgctgaagaaagctggctggaggaaaacctgccgtcagcatttgcacagcatccgtggcgcagctcgcttggctctatcggtggcggcaatcatttcgctgaactgcaacaagttgatcaaatcatcaacgctgaactgtttgcactggcaggtctggatgcacaacatctgcaactgttggttcatagcggctcgcggggggtggggcagtctattttacagcggcatattgcctcgttctcgcatcatggtttgcctcaaggcagtgacgacgcgctacggtatattgcggaacatgacgatgcgctggcgtttgcgtgtattaatcgccagatgatcgctttgcgcataatgcaacaagttaaggccacgggaagtccggttctggatgtggcgcataactttgttagcgcgtgtcaaatcggcgatcaacagggctggttgcatcgtaaaggtgccacgccggatgacaacggtctggtgattattcccggttcacgtggtgattactcctggattgtacagcctgttgcgaacgaaaaaacgctccactcgctggcgcatggggcagggcgtaaatgggggcgcaccgagtgtaaagggcgtctggcagcgaaatacacggtgacgcaactctcgcggactgaacttggcagtcgggtaatttgtcgcgataaacaactcatctttgaagaagcgccacaagcctataaatcggctgaaagcgtggtgcaatgtctggtgcaggccggtttaattattcctgtcgcgcggctgcgtccggtgctaacgctcaaaaacagtggagggaaaaaaggatgatcttgctacaactctcctcagcgcaggggccggaagaatgttgtctcgcagtgaaaaaggcgctggagcgattaattaaagaagctgcccgacaagacgtcgcggtaacggtgttggaaacagaaacgggccgctactctgacacgctgcgttcagctctggtttctctggatggcgataacgcatgggcattaagcgaaagctggtgcggcactattcagtggatttgtccgagtccgtatcggcctcatcatgggcgcaaaaactggtttctgggcattgggcgttttaccgctgatgagcaggaacaatcggatgcaatccgttatgagacgttgcgttcgtcggggccgggcggtcaacatgtcaataaaaccgactcggcggtacgcgccacgcatttggcatccggtattagcgtgaaggttcagtcagagcgtagtcagcatgctaacaagcggctggcacgattgctgattgcctggaagctggagcagcagcaacaggaaaatagcgcggtgctgaaatcgcagcggcgaatgttccatcaccagattgaacgtggcaacccgagacggacatttacagggatggcttttatcgaaggataatgaaggatgaaactgccggaaggcgattaaacgccatccggcagcaaatcaaataattacttcgccggaatttctttcagcagttcagtcagcagtgtccagtaatgacctacgctttcgatgtgaacttgctcatccggagagtgtggaccggtgatagttggcccgatagaaaccatgtccatttccggatacggttttttgaacagaccacattccaggcccgcgtggataatctggatgttcggcgttttgttgaacagacgctgataggtttcacgtaccagatgcatcaccggagaattagcgtccggctgccagccaggatatgcgcctttcgcttcggttttcgcgccagccagtttacccagcgaatccagcatgctcaccacgtagtctttaccgctgtcgatcagtgaacggatcagacagtgaatttctacgttattatcagtcatggtcaccacaccgacgttcagggaggtttcgaccacaccttttgccacgtctgagttgcggatcacaccgttcggggtggcgttcagcagacgaataaaggtatcgcgagatttcgcaatcagggcagctttatcgttcgctacagagtccagcaacaaggccagatttttctctttctctgccagctcgtttttcaggatctcctgataggtattcaccagagatttcaggacgtcgactttatcagctgcgacagcaatggtcgcaaaggcttcacgcgggatggcgttacgcagtgtgccgccgttgaaatcgataaggcgcagatccagttcttctgcatgacccgccaggaagcgcaccagcagtttgttggcattacccaggccaacgtggatttccccgccggagtgaccccctttcagaccttttaaggttaacttgaaggtttcaaaaccagctggaaccgcttcacgatctaaatgcaggttggaggtgaagtcgataccccccgcacaacccatgtagatttcaccttcttcttcggagtcggtgttaatcagaatatcagcctgcaaccagttgctctgtaagccgaacgcaccgtccataccggcttcttcggtcatggtcagcagcacttccagcgggccgtgaaccacgttttcgtcagccagaactgccagtgcagaggccataccaatgccgttatccgcacccagcgtggtgccgcgcgctttaacccattcgccatcaatataaggctggataggatctttcgtgaagtcatgcacggtgtcgttatttttctgcggcaccatatcgaggtgggcctgtaagacgaccggtttacgattttccatacctgcggtagcaggtttacgaatcaggatattacctacctgatcgcgttcgacatggaaacctttctcttttgcccaaccaacaatgtattcagcgagttgctcttcatgataggacgggtgaggaatagaacagattttggcaaaaatatcccacagcggctgtggagataattgagacagttcagacacgttaagtctccttgtcgatcacccgcaaaacagtattgcaggtcacagggttagcagaaaatgttgtcaacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatagttattgatgacctggtggataccggtggtactgctgttgcgattcgtgaaatgtatccaaaagcgcactttgtcaccatcttcgcaaaaccggctggtcgtccgctggttgatgactatgttgttgatatcccgcaagatacctggatcgaacagccgtgggatatgggcgtcgtattcgtcccgccaatctccggtcgctaatcttttcaacgcctggcactgccgggcgttgttctttttaacttcaggcaggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggctcttgatggtaaaaccatccctcactggtatcgcatgattaaccgtctgatgtggatctggcgcggtattgacccacgtgaaatcctagacgtccaggcacgtattgtgatgagcgatgctgaacgtaccgacgatgatttgtacgatactgtgattggctaccgtggtggcaactggatttatgagtgggccacccaggcgatggtgtggcaacaaaaagcctgtgcggaagaagatccgcaactcagtggtcgacactggctgcatgcggctacgttgtacaacattgccgcctatcctcatctgaaaggagatgacctggccgagcaagcgcaggctttatcaaaccgcgcctatgaagaggccgcccagcgtctgccgggcacgatgcggcagatggagtttaccgtacccggcggtgcgcccatcaccggctttttgcatatgccgaaaggcgatggcccgttcccgacagtattaatgtgtggtggtctggatgcgatgcagacggactattacagcctgtatgaacgttattttgcgccgcgcggcattgcgatgctgactattgatatgccgtcggtgggcttttcttcaaaatggaagctcacccaggactccagcctgttgcatcagcacgtcttaaaggcgctgcctaacgtaccgtgggtggatcacactcgcgtcgcggcctttggtttccgtttcggcgctaacgttgccgtgcgtctggcatatcttgaatcgccgcgtctgaaagcggttgcctgtcttggtccggtagttcataccctgttgagtgattttaagtgccagcaacaggtgccggaaatgtatcttgacgttctggcgagtcgtttggggatgcatgatgcttccgacgaagcgttacgcgtggagctgaatcgctattcattaaaagtgcaaggattgctgggacgtcgctgcccaacgccaatgttatcaggctactggaagaacgatccgttcagcccggaagaggactcacgcttaatcacctcatcatctgctgacggtaaattattagagatcccatttaacccggtgtatcggaattttgacaaaggtcttcaggaaatcaccggctggatcgaaaaacgcttgtgttaaaaatttgctaaattttgccaatttggtaaaacagttgcatcacaacaggagatagcaatgacgttaccgagtggacacccgaagagcagattgatcaaaaaatttaccgcactaggcccgtatattcgtgaaggtaagtgcgaagataatcgattctttttcgattgtctggctgtatgcgtcaacgtgaaaccggcaccggaagtgcgtgaattctggggctggtggatggagctggaagcgcaggaatcccgttttacctacagctaccagtttggtctgttcgataaagcaggcgactggaagagtgttccggtaaaagatactgaagtggttgaacgactggagcacaccctgcgtgagtttcacgagaagctgcgtgaactgctgacgacgctgaatctgaagctggaaccggcggatgattttcgtgacgagccggtgaagttaacggcgtgagtgaaatgtgccggatgcatcacatccggcaatatctattaaaactgatacgtcatcccaatcgcgacaatatcatcattattaatattcaatttgttatcgctatccagttggttgattttataatcaacaaatgctgacatatttttgttgaaataatacgtagcaccgacgtcgatataattaaccagatcttcaccaccgatgccctcaatatctttccctttcgataagacataacccagcgatggacgcagaccaaagtcaaactggtattgagcgaccgcttcaaagttctgtgtcttattggcaaagccgccagttattggcgtcattttgcgagtttcagaatagaaagttgccagataaatattattggcatcgtatttcagacctgttgcccatgcttctgcacgcttgccagtgccacggctttgcaggttctgctcgttggtgcgatctgagttggtataggcaccactaatggcgaaatcgctgccgccaaagtcatatgtcaatgacgtgccgaagccatcgccgttttgctttttaacgtcgcggttttcgtttttcccttgatattgcagggttaagttcaggccatcgataacgccgaagaagtcggtgttccgatacgtcgccagaccgctggcgcgtttggtcataaagttgtcggtctgcgccgaggagtcgccaccaaattccgggaacatatcggtccaggcttccacgtcatacaacgcgcccaggttacggccatagtcgaaagaacccaaatctttatacttcaatccggcaaaagcgagacgcgttttttgctgtgcggtatcactctccgctttatttccggcaaactccgcttcccaccgaccataaccagtcagttgatcgttaatttgtgtttcacctttaaaaccaaaacggatataactctggtcgccatctttactggcgttatcactcatataatgcatggctttaactttgccatagacatccagtttattaccgtctttattatatatttctgcagcctgtacagatgcagatgccacaatgcccatcaccactaatgccagagtgctctttttcattttcattcctgattttaattaacgcgcgaatattcagcgggagagccccgttgaaaacaggaaagtttttaacctgagattgttaaagatatattacagattaataatattcttaaaatgtggtaatttattaaatctgtaataaaagcgtaaacaactgccgctaggcttgctgatcccgcgcaacaaaacgccatgctttgctcgcagatggttggcaaccgacgacagtcctgctaaaacgttcgtttgatatcatttttcctaaaattgaatggcagagaatcatgagtgacagccagacgctggtggtaaaactcggcaccagtgtgctaacaggcggatcgcgccgtctgaaccgtgcccatatcgttgaacttgttcgccagtgcgcgcagttacatgccgccgggcatcggattgttattgtgacgtcgggcgcgatcgccgccggacgtgagcacctgggttacccggaactgccagcgactatcgcctcgaaacaactgctggcagcggtagggcagagtcgactgattcaactgtgggaacagctgttttcgatttatggcattcacgtcgggcaaatgctgctgacccgtgctgatatggaagaccgtgaacgcttcctgaacgcccgcgacaccctgcgtgcgttgctcgataacaatatcgttccggtaatcaatgagaacgatgctgtcgctacggcagagattaaagtcggcgataacgataacctttctgcgctggcggcgattctggcgggtgccgataaactgttgctgctgaccgatcaaaaaggtttgtataccgctgacccgcgcagcaatccgcaggcagaactgattaaagatgtttacggcattgatgacgcactgcgcgcgattgccggtgacagcgtttcaggcctcggaactggcggcatgagtaccaaattgcaggccgctgacgtggcttgccgtgcgggtatcgacaccattattgccgcgggcagcaagccgggcgttattggtgatgtgatggaaggcatttccgtcggtacgctgttccatgcccaggcgactccgcttgaaaaccgtaaacgctggattttcggtgcgccgccggcgggtgaaatcacggtagatgaaggggcaactgccgccattcttgaacgcggcagctccctgttgccgaaaggcattaaaagcgtgactggcaatttctcgcgtggtgaagtcatccgcatttgcaacctcgaaggtcgcgatatcgcccacggcgtcagtcgttacaacagcgatgcattacgccgtattgccgggcaccactcgcaagaaattgatgcaatactgggatatgaatacggcccggttgccgttcaccgtgatgacatgattacccgttaaggagcaggctgatgctggaacaaatgggcattgccgcgaagcaagcctcgtataaattagcgcaactctccagccgcgaaaaaaatcgcgtgctggaaaaaatcgccgatgaactggaagcacaaagcgaaatcatcctcaacgctaacgcccaggatgttgctgacgcgcgtgccaatggccttggcgaagcgatgcttgaccgtctggcactgacgcccgcacggctgaaaggcattgccgatgatgtgcgccaggtgtgtaacctcgccgatccggtggggcaggtaatcgatggcagcgtactggacagcggcctgcgtcttgagcgtcgtcgcgtaccgctgggggttattggcgtgatttatgaagcgcgcccgaacgtgacggttgatgtcgcttcgctgtgcctgaaaaccggtaatgcggtgatcctgcgcggtggcaaagaaacgtgtcgcactaacgctgcaacggtggcggtgattcaggacgccctgaaatcctgcggcttaccggcgggtgccgtgcaggcgattgataatcctgaccgtgcgctggtcagtgaaatgctgcgtatggataaatacatcgacatgctgatcccgcgtggtggcgctggtttgcataaactgtgccgtgaacagtcgacaatcccggtgatcacaggtggtataggcgtatgccatatttacgttgatgaaagtgtagagatcgctgaagcattaaaagtgatcgtcaacgcgaaaactcagcgtccgagcacatgtaatacggttgaaacgttgctggtgaataaaaacatcgccgatagcttcctgcccgcattaagcaaacaaatggcggaaagcggcgtgacattacacgcagatgcagctgcactggcgcagttgcaggcaggccctgcgaaggtggttgctgttaaagccgaagagtatgacgatgagtttctgtcattagatttgaacgtcaaaatcgtcagcgatcttgacgatgccatcgcccatattcgtgaacacggcacacaacactccgatgcgatcctgacccgcgatatgcgcaacgcccagcgttttgttaacgaagtggattcgtccgctgtttacgttaacgcctctacgcgttttaccgacggcggccagtttggtctgggtgcggaagtggcggtaagcacacaaaaactccacgcgcgtggcccaatggggctggaagcactgaccacttacaagtggatcggcattggtgattacaccattcgtgcgtaaataaaaccgggtgatgcaaaagtagccatttgattcacaaggccattgacgcatcgcccggttagttttaaccttgtccaccgtgattcacgttcgtgaacatgtcctttcagggccgatatagctcagttggtagagcagcgcattcgtaatgcgaaggtcgtaggttcgactcctattatcggcaccatttaaatcaataagttacctcgcatttaagtaaaccacgttctcctcttgtgccgtatttgtgccattgcgacttataatcgcatcgattttgcttgcgtgctcggtgagatgcccggctgaaaggtgggcgtatctttgaaccatttcgagagtttcccatcctcccatctctttaagtgcaagaagagagacaccagactgaaccagccagcttgcccaggtatgcctcaggtcatggaagcggaagttgctaatgcctgcccgctttaacgctcccttccatgccttgttgctgtcggttctcatcttccttaccgctgctgtttttgttccgtcgcttcggtaggcaggtttggtgtggacaaacacccatctcttatggagaccctgctgttttcttaatatctggcatgcggtttcgttaagaggaactccgatcgcattgccagcttttgtttcatcagggtgcatccatgccattttcttatccagatcgacctgtgaccactcaaggtctgtaacgttggaacggcgaaggcctgtcgtgattgcaaacatgaccacagggaagaaatgaggagcaatttctgcaaacaggcgcttcgattcctcctctgtaagccatctgattcgtccattcttaacgcgtggtgttgatattttgggcgccctgtcaagccatccccattcaacagccatattgagaatagcgcgaagtattgccagatgccgcgtcttcgttcctttgcttgccagctttggtttatactccggcactggcttgccaagccgcaaacacctgtcccggctcatttcccagttcaggcgatggcggcggttttccatcccgtctaccgcctccattattttttctgttgttatgtctgagagaatggtttctctgaagtgcaacatccagaacgatataatgctcttgtcatcatcaatggacttcttatccgatttctcacgcagccaccgtatgcaggcttccttgaatagctttttcggtgattccccgagattttttactctccacgcttctgctttcagacgatcgtgaagttcttgcgcttgccttttgtccgatgtttcaagagagcgtctaactcttgatccatctggcgcgacgaaatcgcagtgccacgtgccaccgcgtagtttgattgacatgctttaacctcctgcacatcaaccgcattcaccgcgctattgtgtctcacagacttaagcgccgcaatgcagtctgacttgcaaatgcgatatggacttttaggtttatctggatttatctttgcggcctgaagtcgtccacttcgtatccactgtgtgatagtgcctttgtctaccttcagatacgacgcagcttcttcacgagtgaagatttcttcttccacctggaatctccatttgttggattgacattattgcggtaggtctggatatcttgagaaatgaacaggcctcatcgagtgtgaggcgttagtccttgcgtagctcgctgattcttctgtaagtctgtggtgctttgtttccgtgtatcttcatttcagacttcaacagagcaacgagggaatcccattcgttgaggatgcctttgaatgtcggaacgcgctttgcaaccttgtcgaatgaatctctgatttctggaatctgctcaacaagtgcaacgcatcgccggaagtctgctgcgtcatggggagcgccgaagtgatgaccatagatattctttttcagtccacatgcgattgaggcaagagttgcgctactgatgccaacatcgccagtcgattgccatttcaaaaccttcatagccaaatctgacatttcttgtctccataaaacaaaacccgccgtagcgagttcagataaaagaaatccccgcgagtgcgaggattgttagttgctatctgctgcttccttggtcattaccatatccacccaatttcaccagacatgattctcgcaatcactattatcaccaaagtgataatcacaactttaactggcggcatcattcaccatcctgctccggcggttctggcagcggcatccagtgagttacgtcatccaagatatttcctgataaatacgtgaaagctctatattttttgtaatcaattggatttacaacccagttccaatatgcggccacgatttcaccttgactaaatgccagtaacattttggtgtcttccggcattcgatcactacagcttatccaactacccggagttaccggagagttgccgcgttctttaatgtgcaagcgaggctcaccatcttttggttcaggccactggcgttccatgttgatcttcaatttattttccatagcagcggtaatttcagcatcactgataccagcacggcgctgtgcatcccacaacagaaactgcatatcagcccactcgctaagatcgtctggttcggctgcggcttccagtgcctcttttgagagatgtttcagcggaccaatggggccaacgcagccaaatgtggagtcagaccatttggcatgctcgtggcgaatctgttcgcgttccagtgatgccagtgcaattcgtgccagttccatttgttcgccacgagtaagtccgttatcaagcggatttttaatgaataatttgatacgttctttggttatagcgctcatatcactctcctttgatgcgaatgccagcggtgcgggaatcattccatcgctttacttcttcacgaattacgtcaatgcattctttcgaatccattaggtaatcttcatcaaaaagacgttcctgttcgttttctatcgcaacaatgattgcttcaactaacttttgtgcctgagaatcactttctaactctgctatgcgcttctctgcggcttccaacttctcgcgcatatcgtcaacgtactcgaccagagatccgccagcaggaatttcgcactcctcgaccagttggaagtagatatcagctgcggcccgtgtgttgctatgcctagcgtcgcccatctcaccttcacgaagagcatcgcgttcggcggtaagattggctattttgctgtctttgccttccagctcaactctcagcttcccaaccgtaagagcaatatcctcgttctcctggtcacggcgtttgatgtattgctggtttctttcccgttcatccagtagtgccagcacggtttctggtccggccagaaatttgaaggcgttgagcgcatcaatatccacaccgtaatctttaagttcctgttcacttaacaaatcatcatcagctggcaacattaacaggcgttccattgctggaattgcacgttccgccgcctcacgtagtgcctgatagtcaattgtcatactcgccatccctcacagttgtaatcactacagccttcaaaatcatatgggctgtactgccaggtgatttttccgcaatgcggacaattccaacgcaccttcccgcttcgcgacttctttcttctgttctgctctttcaaccagtcaggcatgaccaaacctgcgccctgaaccattgttctgcggttaaagttattgatattgaacgtccggcgctttgctgcatcagcaatggaaaatggcaaccaaactattcctggttcgtttttgttggcgacgctaaagatggtcgctttactgaagtcatctgttggcaatccaccgtgttgaagccagtaaacatcgttgccgttccagctaccttttttgtaggccacatacgcagtgcaatctgactcaatcaggctttctgtggggatgtactggcaatcaacgtgccacacagccattgcatccacgctatcagcgcaaacaggctgatcgatatctcgtccacaattccaggctttttgggcttcttccagcgtgtaaacatgagcgcgatcgatatcagaactgtaaccattgccgttatggcaatggaatgaggcgttattacccacagtttcacgcaagcacatcatgtaaaagcggttattcactggttgcctcctttacgccacatcgcattcagatatttgttttgatttactgatggaaaagaatttctcttaagcaattcctctctcgatggcattggctttacgcgttggcgaataatcatttctgccggaagaatgccgggattgtatgcaagtcctctcatggtaaattcctctttgttaatttattcgtatgcctgctctttcttcatcgagtttttttagcttgtatcgcatagcccttactgaataaattgagcggcaggttgcaattgctatttcttctgcggagaacttaccgaaaagtgatacttcggctcttgtccatcgtcttccacgaagtcggctaacaatgtcagcgccaatccttgttgctttcgccattactgctttttcagtcctttccagtttttcagcgataacttcaactggcattgtcgccgctacttcgcgtaagaaatcgacttcccatttctcccatggattctttttcataggcgataccgttatttgataagaagtgaaggtttcccaactttgagttgagcgccggggatatttattcctgcttttagttggtgtttgattgccagtttgtcggctttaattgttgtttcaaactcaacgtattctggaggaagggcgcttgagtcgatgatttctacagtttctgacggtttgcggattgttacctggtgaatacctgctcgaatctttttctttccaaccatttcaagcgatgacgctatatacgtcataatgctatcaatcttattttgaattactgctgctctttcattcagtgactttgcctcttccttgaggcgttcagcataaccatgaatcgccacgggtttaacagacacctcagagtcatttaagatggcttaaagagaggtgcccatgagcggtaagcgttatcccgaagagtttaaaactgaagcagtcaaacaggttgttgatcgcggttattctgttgccagcgttgcaacacgtctcgatatcaccacccacagcctttatgcctggataaagaagtacggtccggattcttccactaataaagaacagtcagatgctcaggccgagatccgccgtctccagaaagagctgaaacgggttaccgacgaacgggacatattaaaaaaagccgcggcgtacttcgcaaagctgtccgactgaggtacgcctttatccgtgacaactcctgttgctggcctgttcgcctgctctgtcgggtgctggatgttcatcccagtggtttttacgcctggcttcagcagccgcattcacaacgccatcaggcagacctgagactgacaggacagattaaacagttctggctggaatcgggatgcgtctatggttatcgcaaaatccatctggatttgcgtgacagcgggcaacagtgcggagtaaacagagtctggagactgatgaaacgtgtcggaataaaggctcaggtcggataccgaagcccgcgggcacgtaaaggcgaggccagtatcgtgtcacccaacaggctccagcgacagttcaatccggatgctcctgatgagcgttgggtaacggacataacctacatcaggacccacgaaggctggctgtatcttgccgttgttgttgatctgttctcacgcaaaattatcggctggtccatgcaatcccggatgacaaaggacattgtcctgaacgcactgctgatggctgtatggcggcgtaatcccgaaaaacaggtgctggttcattcggatcagggcagtcagtacacaagccatgagtggcagtcgttcctgaaatcacacggcctggagggtagcatgagccgtcgcggtaactgccatgataatgcggttgcagaaagttttttccagttgttgaaacgtgaacggataaagaaaaagatctacggaacgcgggaagaagcccgcagtgatatttttgattacatcgaaatgttttataacagtaagcgtcggcatggttctagcgaacagatgtcaccgacagaatatgaaaaccagtattatcaacggctcggaagtgtctagattatccgtggcgattcaccagactcatttttaataatggcaagaagttgctctattttatcggtaaattctccttccatgccttctattgtgtcagcaatcatctctggctctaaatctgaatccatcaattttgcgtattcattggcaatttcatacagtttgctcactggcaacctccagtttcgctttgcattctgcgtaaatggcttgtatgttctgctgcaatttcattccagatgtcaggcgatatgcttctgcaaaatatctcttcaaatcatccatgttttcagcctgagtcatttcatcacaaagaagttgtgctttttccattatttcctgctggcgtttccgttcatcttcgcggatatcttcctctgatttgtgcggcataactggttcctgatgcataccttcatcttcgttaagcaggtgaatggcattatccagtcgctgggctttaggccagtatttgctggcgcgtttaactattgttttacgtgccatctcttcccagaatgttttccacggtccattctttgccttgctcgttgcttccacagctttaatttctgccagactcatttcttcagtcaggtagtcaccatctgctgttttaaccgtacaataaccaccaacaatagagcctcgctcaccaaatgcgttgtatttgtgggttggtgctgaatcaaggccatttgattcataggtgtcgtttgagtacaccagtttgcattgcccccacttaattgatcctgtcgattgcgcaagatgaagtaaccccatgtaactgatatcaaggcaaaccatgccgtcgcgcggaaccagataagccagtttgctagccgggtttaaggtgataccgatcgccgcaacattgatgatggcgttctgtgcgctggttggatttgccagtgccgttttagccaggtaatcatttttctggaaatactgaattgcaaactggctttccttagcccatgtcaccgtctgttcagtcaatgctccgcagaataactgctcctgctgtttaacgaattcaacgatattgctcatgctgcttctccataaatgtgtctgcgtttgaatattgcgaaggcatattcagccttaactctttcgtttattgcatcccagaaccattcagcggctttttcctgatagttacagtcatcatcttccagccagtcgatagcgtccttagtgtgttcatctggtttatatgagcgaagcatttcgcttattgggtcgcaacgtttgcagagacgatcaacttcactgttgattcgttcgtaatcttcatcagtaaaacttgcgattatttgcgatatttcacgcttatcattcagagtcagaatcatcatctttctcctgttctttgtgctgattgagcattttgttcatctgacgaatgaattcttcgtctgaccagttatctgtaaaactcatggacggccttgttgtttcaaaatatcccaaatcttttcgagcaagcttttcattcttggttgtttaaagtctgctccggttagaatgttttttcgtgaatgctgtaccgataaaatcgggttgaaagggcgaaccgatgccgcccctgcaatagcgaactgttgcataggatgctccttctgtttgattgcataacgaaaacgcctcgagtgaagcgttattggtatgcggtaaagccgcactcaggcggccttgatagtcatatcatctgaatcaaatattcctgatgtatcgatatcggtaattcttattccttcactaccatccattggaggccatccttcctgaccatttccatcattccagtcgaactcacacacaacaccatatgcatttaagtcgcttgaaattgctataagcagagcatgttgcgctagcatgattaatacagcatttaatacagagccgtgttttttgagtctgtattcagagtctgaccagaaattattaatctggtgaagtttttcctctgtcattacgtcatggtcgatttcaatttctattgatgctttccagtcgtaatcaatgatgtattttttgatgtttgacatctgttcatatcctcatagataaaaaattgcactcacattggagggcaaagaagatttccaataatcagaacaagtcggctcctgtttagttacgagcgacattgctccgtgtattcactcgttggaatgaatacacagtgcagtgtttattctgttgtttatgccaaaaatgaaggccaccatcaggcagccttgttgtaaatgttgcaggtatcaagtaagtaattagatggagcgccataaattatgaattcatcgtttgtcgggtccatctccatctcttggcctattgccattcttgcgtcagtgtcatcagcggcgaagcataaaacagcccacgcacccattgttttaaaaagaactgcaattggctgtggttttactgaatttgcgttagcgcgaaaatcataaatcgcactttcatgaaattccatatatcacctcaaataagtggtttgctacctaatttcattttctggcgaccaacacaagtcacgcccatttcactgcgtggcttgcggtagtaaattaagtttgttcagacaataaaaaacccaccgaagtgggctatgaccattttttatttggatttcgttggtgagcgtgattaacaactctgtgcatgacatcctcatatttttcatcttcaattttttcgacatcgcgaggaaatggtgttgctaatgctttgtcaactttgtccattggttcttcattaatcttatattcaggaccgtcatctatagcattaaatccaggtgttacaccgttttttaatgcatatgctatccttttttcccatctcgctattctcctcctgtctcgagatgtaagacctctatcagatacttttctgttttgtccgcggtcaggattaacataaatagtctttttcaccataagcatactcaataagcaccgtacggtagtttactgtacaattttattttttggactgcatgtattttgtttcctaatgggtttgaatctttgtaataaatacttctattttttcgaacgacttcttctttcttcttgcagcaaaggcttcctagtgatgctgctttgtctgctctgacgcaaccagagagctttagcgcaatttttcgcgccagtgcttcattactgcgtcgctcggcaataagttctgctctgcgagctttgtagcggctttttgccgtacctttggattctttccagacaatggttaccatgatggtctcctttaagtggctttggcgcatgacgcgtcgaggtgcttatcttctcgatcgctgtcttgcagctgcaattcgcgccatccccaaaaccactcaagttctggtctcaacggttaggttgagagtccgtcgatgttaaagagcctgccaatctgttccgtttggcttccagcgtcctgctgatggcttaaatttaagacttcttaatttattggtcaagtgcatttttgaagaaaacttaattttatgggcgtgaatttagtttgtctttgatttttaacgggaaataaaaaaggggcgaaagccccttaaggaaggtttgctagcttggcatcaacgacaacgccaatgattttacagttcccattgatttcaatcattgggtattgtggattgagtggtttcaggaattttctaccggcatcaataactaactttttgaatgtcgcctcgttttctccttcaagtttggcgactaccagctttccattacgtggttcgacttctgggtcgacgagaataatcatcccctcaggaatactcagtcctgccggggcagtcattgaatcgcctttaacgtcgagccaaaaagagtcttcagaacaatctaccgttgtgtcgtaccagttatctattgcacgcctatgatatggctctacagcttccatccaacatcctgcgcttacccaactaattagaggatacgaacctcttggatcatgcctgctgtgataggcaatgtttgaaagactatcctctcctttcaacaggtaatcaggggagcactgcaaagccttggctaaggccaataggttttcgccattgggctcagtttcagatcgctcccattgggaaatagcaacattagacacgccaaccatcttgccaagggcagcctgcctaatcttgagttcttttctgcgagcgcgaatacgctcacccatcagttgtgtattcatagttaagacatcttaaataaacttgacttaagattcctttggtggataatttaagtgttctttaatttcggagcgagtctatgtacaaaaaagatgttattgaccacttcggaacccagcgtgctgttgctaaagcactaggcattagcgatgcagcagtctctcagtggaaagaagttatcccagagaaagacgcctatcgattggaaatcgttacagctggcgccctgaagtatcaagaaagtgcttaccgccaagcggcataagcaaattgctctttaacagttctggcctttcacctctaaccgggtgagcaaacatcagcggcaaatccattgggtgtgccgctataactcaatatcaatataggaaaattaacaaatggcacaagcaagctacagcaagccaacacagcgagaaattgatcgcgctgaaacagatttactcatcaacctgtcaacgcttacccagcgcggtctggcaaagatgattggctgtcatgaatcgaagataagcagaacggactggagatttattgcttcggtcttgtgtgctttcggaatggcatcagacatcagtccgattagcagggcttttaagtatgcgcttgatgaaatcacaaagaaaaaatccccggctgccaccgaggattttaagcaaattgatatgcaattctgagggaattactggatcaatccacaggagtaattatgacaaaacaactcagtccttaccaggacaaaattcacaaacacatactacgtgatcgcttcctgtccagcttcaagcagcctggtcgattccgggctgagttggaaaaagtgaagctgatgcagaaggagaaaggtcatgagtaacatatctaatctagccgaagccagagaggccagaaggctacaacaaccgcatcaaagcagcggtaaggggtatgccttgctgcaccgtaaaattatggatgtgccgttttacaaggacgcagaagcagcgcatctgtgggttcacttaatcctcaaagcaaagcatacgcctgagtatgtaatgactgacgcaggagaaattctggtaggcagagggaagctacttggcggtagaaactctctggcgtttgaaacaggactcaaaccagatcgcgttcagtacctgcttagaaagttcaaaaaactcggcatgattgactgggtttcacacggtaaattctcagttttctcggtagagaaatatgacgattatcagtcaaattttgtaccagcagattaccagcaaattaccacctcaaagccagcaataccattgcctgtaagcaatactgtaccagcagattaccagcaaattaccacagataaagaatataataatattatctctaatactgacgtattagagagtgccacagcagacaaaaagtctgacaagaaaaaaccttccgtcagctgtcaggatgtagtcgatgcttaccacgaaatccttcctgaagcgccaagaatccgcgcactgaatgacaagcgtaaaaaccagatccgaacgttctggcgcaaagccggagtgataacccgccagcttgacgggcatgggttcacgatgcaggactggagaaattatttgagctacgtaggcgaaaattgccgatggatgttcgaagaacgcccaaaccatcaacgcggaaccgtctggcacaaaaagggatttgatttcctgcttaacgataatacctacctgaaagttcgtgagggtgaacacgatgaccgataatttttatgcgccgccccatagcatcgaggcagagcaggcggtgattggtggattgcttctggatgatgacagcagtgagcgcgtccagaaagttctggcgatgctgaagcctgattcattttacagccgaccacacaaaatcattttcgaagaaataaccagaatgcaccgggagcaaaagccagtagatggcctgacgcttttcgatgaactggagcgtaaatcgttaacggcgtctgttggcggttttgcttatatcgctgagatcgcaaagaacacgccaagcgccgcaaacatcgttgcctatgcaatgcaggttcgcgaaaccgcaatggaacgctacgccatcaaccgcatgactgaagcgacggaattgctctattcccgcaacggaatgactgcaacgcagaagtacgaagctattcaggcgattttcacgcaactgacagaccatgcaaaaaccggatcgcgtcgcggccttcgctcatttggtgaggtcatggaagactgggttagcgaccttgagaagcgatttgacccgtcaggcgaacaacgaggaatgagcacagggatcccatctctggacaggatgctgtcaccgaaaggtctggtgaaaggctctctgttcgtcattggcgctcgccctaagatggggaaaacgacgctatacagccagatggcaatcaactgcgcagtgcatgagaaaaagcccgctctgatgttcagtcttgaaatgcctggcgaccagatactggaaaagctggtaggacagaagtcaggtgttaacccgaatattttttaccttccggcgacaaatgacgccgatgacggctatcagggtgattacgatggtgacttcaacagggcgatcgaaacagccaatcgcttgagtgaaatcgacatgctttacatcgacgacacgccgggattatctctggctcaaatcgtcagcgaaagccgtcgaatcaagcgagaaaaaggatgtgttggcatgattctggtcgattacctgacactaatgaccgctgagaaggccgatcgcaacgaccttgcttacggcatgatcaccaaaggactgaagaaccttgccaaagagcttgattgcgttgttgtgcttctgacacagcttaaccgcgcactggaaagccgaaccaataaacgcccattaccaagtgactcacgagatacagggcagattgaacaggattgcgattattgggtggggatccatcgtgaaggtgcttttgatgacagtgttccacctggtgaaaccgaactaatccttcgtctcaatcgtcatggcaataccggcacggtgtattgcattcaggcaaatggcgctatttatgacacagaccaacagtctgctgaaatgcgccgccgtgaacgcgaggaaccgcaatccaagaagaaaggaggattctgatgaccatctacatcactgagctaataacaggcctgctggtaatcgcaggcctttttatttgggggagagggaagtcatgaaaaaactaacctttgaaattcgatctccggcacatcagcaaaacgctattcacgcagtacagcaaatccttccagacccaaccaaaccaatcgtagtaaccattcaggagcgcaaccgcagcttagaccaaaatcggaagctttgggcttgccttggtgacgtttcgcgtcaggttgaatggcatggtcgctggctggatgcagaaagctggaagtgcgtttttacagcagcattaaagcagcaggacgttgttcctaaccttgccgggaatggctttgtggtaataggccagtcaaccagcaggatgcgtgtaagcgaatttgcggagctattagagcttatacaggcattcggtacagagcgtggcgttaagtggtcagacgaagcgcgactggctctcgaatggaaagcgcgatggggagatcgggcagcatgatgcgatgttatcggtgcggtgaatgcaaagaagataaccgcttccgaccaaatcaaccttactggaatcgatggtgtctccggtgtgaaagaacaccaacaggggtgttgccactaccgcaggaaaaggaggacgtgtggcgagacagcgacgaagtatcaccgacataatctgcgaaaactgcaaataccttccaacgaagcgctccagaaataaatgcaagccaatcccaaaagaatctgacgtaaaaaccttcaattacacagctcacctgtgggatatccggtggctaagatatcgtgcgaggaaatgacaatggattattcacagttaagtgattttgaaattaacgtggcggtattcgaagccattcataacggatcaccggattacaaagaaggtgagaatggcgatatggtgtttgtctcatttgagggagacattgtaaacggagacgcagttgaagtagaagttgagcgcggatcctttaacccatgcgcaaacccagcagacgcatggccgattattgaaaaatacaggattagcattatcaatctcgatgaagacgagtggggtgcacgcggtgtggcctactgtaaatctaagcgagctatacatgaaaatcccctccgctccgccatgattgtctttctcatgatgcagagaatccaataatgattagcccatcccaatccattcaataccagaaagaaagcgtcgagcgggctttaacgtgcgctaactgcggtcagaagctgcatgtgcttgaagttcacgtgtgtgagcactgctgcgcagaactgatgagcgatccgaatagctcaatgtacgaggaagaagacgatgagtgatttctctgagcttatttccttcaaaaaagacagagaagaaatgcggactgaatctgtctattacgttcaacaccggaataaacgctcggtgcttgatcaggagctggttattaccggagacctggcattcagaacatataaggccagcatggaaatgaaggatttacctaaatgtggttctgaaagagaagccgcgttaaagctggcagagtggatgcagagaatggctgctgcaattgagaattactggagtgaaccataatggctaacctacgcaaagaagcgcgcggcagagaatgccaggtacgtatttacggcgtatgcaatggcaatcctgaaactacagttctggcacattaccggatggctggaatttgcggaacgggaatgaagcctgacgacctgatcggcgcatgggcttgtagcgcgtgtcacgatgaaatcgaccgacgcacccataatctcgacaacaaagacgccagactttaccacctcgaaggcgtgatcaggacgcaggcgatactgctgaaggaggggaagattaagccatgaacgaatatcagtttgtgcttccatacccgccgtcggtgaacacctactggcgaagacggggaagccaatactacatcagcgctaaaggccagaaataccgaaaagatgtacagcaaataatccgccaactcaagttagacattttcaccaaatcaagactccgcatcaaagtcatcgcagacgttccagactcccgccgccgcgacctcgacaacatcctgaaaggtttactcgactcccttatccacgccggatttgcggaagacgacgagcaattcgatgacattcgcgtaattcgtggcgtgaaagtaccaggcggaaggcttggaataaaaatcaccgaactggagaacgcatgaacgccacaattcaaacgataccagagcttcttatccagacacgaggcaatcagaccgaagtggcgaggatgctttcctgcgcaagaggaacagtgctcaagtacaaccgagacagcaaaggcgagcgtcacgtaatagttaacggcgtcctgatggtcaaacagggcaaaaggggaaggccatgagactcgaaagcgtagctaaatttcattcgccaaaaagcccgatgatgagcgactcaccacgggctacggcttctgactctctttccggtactgatgtgatggctgctatggggatggcgcaatcacaagccggattcggaatggctgcattctgcggtaagcatgaactcagccagaacgacaaacaaaaggctatcaactatctgatgcaatttgcacacaaggtatcggggaaataccgtggtgtggcaaagctcgaaggaaatactaaggcaaaggtgctgcaagtgctcgcaacattcgcttatgcggattattgccgtagtgccgcgacgccgggcgcaagatgcagagattgtcacggtacaggccgtgcggttgatatagcaaaaacagagcagtgggggagagttgttgagaaagagtgcggaagatgcaaaggcgtcggctattcaaggatgccagcaagcgccgcatatcgcgctgtaacgatgctaatcccaaatcttactcaacccacctggtcacgcactgttaagccgctgtatgacgctctggtggtgcaatgccacaaagaagagtcaatcgcagacaacattttgaatgcggtcacacgttagcagcatgattgccacggatggcaacatattaacggcatgatattgactttttgaataaagttgggtaaatttgacccaacgatgggttaattcgctcgttgtggtagtgagatgaaaagaggcggcgcttactaccgattccgtctagttggtcacttcgacgtatcgtctggaactccaaccatcgcaggctgagaggtctgcaaaatgcaatcccgaaacagttcgcaggtaatagttagagcctgcataacggtttcgggattttttatatctgcacaacaggtaagagcattaaagaactggcaaagagcttaacggtctgcgaaagcatttcttagtggcacaactggccggtacaactgagtgctctttccggtgtggtgaatgcgcaggctgatgcgcgcaggagagcttcggaagaacaaggtgcctgtatacaagccggagatcagcgccggccaccacagccaaatccacccagagcaaaaccgttgttcatccttaccattccctcagtattttgggctacaaccctcagcccattttttaaagcgtacttccaccaagaaccagacctaaccaactcattgctgacactctgtggatacggttgtctagtgcgctttaaaaaagaaaacccagcatcaatggctgggcttcgtgatatgagcggcatgtattgttggcgcaatccacgcctgatttgctcatgaatgcggtcacgaacaaacccgttacaaatcaaccgtaacccggatttgttcgagcgaccatatccataattcctaatttgaacagatccccttctgggggtaagacatgaagatgccagaaaaacatgacctgttagccgccattctcgcggcaaaggaacaaggcatcggggcaatccttgcgtttgcaatggcgtaccttcgcggcagatataatggcggtgcgtttacaaaaacagtaatcgacgcaacgatgtgcgccattatcgcctggttcattcgtgaccttctcgacttcgccgggctaagtagcaatctcgcttatataacgagcgtgtttatcggctacatcggtactgactcgattggttcgcttatcaaacgcttcgctgctaaaaaagccggagtagaagatggtggaaatcaataatcaacgtaaggcgttcctcgatatgctggcgtggtcagagggaactgataacggacgtcagaaaaccaggaatcatggttatgacgtcattgttggcggagagctattcactgattactccgatcaccctcgcaaacttgtcacgctaaaccccaaactcaaatcaacagcagccgggcgttaccagcttctttcccgttggtgggatgcctatcgtaagcagcttggcctgaaagacttctctcccaaaagccaggacgctgtggcattgcagcagattaaggagcgtggcgctttgccgatgattgatcgcggtgatatccgtcaggctatcgaccgttgcagcaatatctgggcttcactgccgggcgctggttatggtcagttcgagcataaagttgacagcctgattgcaaaattcaaagaggctggcggaacggtcagagagattgaggtatgagcagattaaccgcgattatctccgctctgattatctgcatcatcgtctgtctgtcatgggctgttaatcattaccgtgataacgccatcgcctacaaagaccagcgcgataaagccacatccatcatcgctgatatgcagaagcgtcaacgtgatgtagcagaactcgacgcaagatatacaaaggaacttgctgatgctaacgcgactatcgaaagtctccgtgctgatgtttctgctgggcgtaagcgcctgcaagtcgccgccacctgtgcaaagtcaacgaccggagccagcagcatgggcgatggagaaagcccaagacttacagcagatgctgaactcaattattaccgtctccgaagtggaatcgacaggataaccgcgcaggttaactacctgcaggaatacatcaggacgcaatgcctgaaataatttttttgcaaatcacaaagtccatttaatgagcctcgcggtgcggggcttttttatatctgagtttcacagcgcatctcacgcgcatattaacgagagcctttcagtaagcgagcctgagaaaagccgttataggtggcgacctctctcgggcggcttttctgtgagacaggctcactttctaaaaggtaaagacgctatgaatcatcaattggctaatctcgatttccgggacatggtggttgtttctggtgatcgcgtgatcacaacctcccgcaaggtagcagcttacttcgacaagcagcatcaccacatcattcagaaaatcgaaaagctagactgttcggatgaatttctaaccagcaacttttcgcgggttacctatgaacacaagggtaatcagtatgttgaatatgaaatttccaaagacggcgcgatgtacatcatcatgtcgtttaccggcaaaaaagctgccgccatcaaagaggcgtttatcaaagcatttaattggatgcgtgacaggctgatggagttggctcactcataccaaagagagcacaacgagttaatgctggagttcatgaaggaaaaggatgttgccagtatgtcaggacgcttgctgagccgctggggcaggatcaaaaaaccgcaactcatagcaagaatcgaaaggcttgagcagcaggcgcaaatatcgatccccggactgccaaagtgaccattccaaagcccatctacaggtgggcttgataatgaaaccgtgatttacatccctcacaatccaggtatgtaaaagctggatcatgcgagaacggatttaactaaatctgtgcgccaccagttaacggcagtaccacgaaacaacccaagccagtaagtggggaaataacactggcagccactgaaagatgaaccccctgccttatggcaaaaaagattctttgtgttggcggactgatggaaagacatcggttattgcagaggccattcaatgagtggtctcgacaatggcttataccatacacgggataacttaactgatatcccttttaacggataaacggagccaataatggcagagattattcccatgactgaagaacagaaattccagttagagatttacaaactggtcatgaaccagaacgcagccgcagaagaagcatttcagttcattggcactgacgagctgaagcttgagctattcaaaattcacttccagtcaggtggcgctaattcagatatcacgacccgcactatcgaagcggtgcgtaaatcgaaggaagcgttagacctgttcactaccggagcataaacatggcgcgcccaacaaagtatcaagaggcgtatgccgaacaggcacgcaaactgtgcttgctgggctacaccgatgcagagcttgctgatttcttcgaagtcagtgagtcaactattaacaagtggaagcttgattatcctgagttttcggagtccataaaaaagggtaaggccgtcgctgatgcagaagttagtgaccgtctttatcaacgcgctatgggcttcgtggctccagacatcgatattcgtgttattgaaaacagaattgtcgaaactccgcttgagaagtattacccgcctgatacaaccgccgccatcttctggcttaagaaccgacagaaggataaatggcgcgacaaggttgatcacgagctaacaggcaaagacggcggcgcaatccagattgaaacatcaccgatgagcactctattcggaaaatgacctcgattaatcctatctttgaaccgttcattgaggcgcatcgctacaaagtcgccaaaggcggtcgaggtagcggtaagtcatgggcaattgcgaggctgcttgttgaagcggcgcgtcggcagccagtgcgtattctttgcgctcgtgaactgcaaaacagtatcagcgattcggtaatccggttgcttgaagataccatcgagcgtgaagggtattcggctgagtttgaaattcagcgttccatgattcgtcatctcggaacgaatgctgaattcatgttctacggcatcaaaaacaacccgacgaagattaaatcgctcgaaggcattgatatctgctgggtggaagaagcggaagcggtaacgaaggaatcatgggatatcctgataccaaccatccgtaagccgttctctgaaatatgggtgagctttaacccgaagaacatactcgacgatacctatcagcgattcgttgtaaatcctcccgatgatatttgcctgctgacggtgaactacaccgacaacccgcactttcctgaagttctccgtctggagatggaagagtgtaaacgcagaaacccgacactgtatcgtcacatctggcttggtgagccagtaagcgcaagtgatatggcaatcatcaaacgtgaatggcttgaagccgcaaccgatgcgcacaagaaactcggatggaaagcgaaaggcgctgttgtctctgcacatgatccatcagatacagggccagatgctaaaggttacgcatcgcgccacggttcggtagttaagcgcattgccgaaggtctgctgatggacatcaacgatggtgctgactgggctacttcgctggcgattgaagacggcgctgaccactacctgtgggatggtgatggtgttggtgccgggctacgcagacagacaacggaagcgttctccggcaagaaaatcaccgccacgatgttcaagggcagcgaatcgccattcgatgaagatgcaccgtatcaggccggagcatgggccgatgaagtcgtacagggcgacaacgttcgcactattggcgatgtattccgcaataagcgagcgcaattctattacgcgctggctgacaggctgtatctgacatatcgggcggttgttcatggtgagtatgcagaccccgacgacatgctgagtttcgacaaagaagcgataggcgagaagatgctggagaagctgtttgcagaactgacgcagattcagcgcaaattcaataacaacgggaagctggagctaatgactaaggtcgaaatgaagcagaagctcggtattccatctcctaacctggctgatgcgctgatgatgtgtatgcattgcccggagtcggctgcgcaacccgactattccagttactcaattccttgtggtgtaggttgatatggcagaaaaaaagatgactgactggcatcgcaaggtgctgtgcaactttgataatgcctggtcagcaacgcaggatatgcgtgagcagattattgaggctcaacgtttcgtcagggtgtccggcgcacagtgggaaggcagcacaaacgctggttactcatttgatgaaggcaggtttgagcattatccgcgttttgaactgaataagattgcccgtgaatgtgatcgcatcattggcgagtatcgacagaatcgcatcagcgttaaattcaggccgaaggacgataaggcatcggaagcgttagccgaaaagatgaacggcaaattccgcgctgactatcaggaaacatccggtggcgaagcgtgtgataacgcatttgatgatgccgtaacgggtggattcggttgtttccgcatgtgtgccgattacgaagatgaaatggatccgagtaacgagcagcgacgcatcagccttcttcctgtttacgacccagcgacatgcgtcttcttcgatcaggacagcaagcaatatgaccgttctgatgctatgtgggctatggaaatgttctccatgacgcctaaagcgttcgaggctgaataccctgattccatcgcggcaagcctttctcgtgatgacactggtactcagtatgactggtcaacgcccgatgccatctatgttggacgctactacgaagttcgcatagagaaggtgaagctcacggcgtggcgcaaccctgttagcggagaaacggcaatttatgatgaagagcaaatcaaagatattgtcgacgagctgaccgatggtgcattcgaactgattggcgagcgaacggtgaagaagcgccgcgtttattgcggtcttctgtctggcgctgaatggctggaagaacctaagcgtattccgggcgaacatattcctctcatcccggtatatgggcgtcgctcatttgttgataatcaggagcgaatcgaaggccacgcagcaaaagcgatggatgcacagcgtcttgagaacctgatggtttccatgattgcagataacgctactcaggctggcggtgatggcattcctgtagttgatgttgacatgattcctggtcctctcgccactcattgggcggagcgcaacaaaaagcgcccggcgttcctgccgatggtcagtctgaaaaacaaaaacggagatattactgcgcaggctcaggtcagcagttatacgcctccgacacaaatgcctccagctcttgccgggctattgcagtacaccggaacggctattcagcaaattacaggtgcgtcgcagattgagaacatgccgagcaacgtcgccaccgataccgttgatagcatctttaaccggatggacacgcagtcctatatctacatggacaacatggctaaatccatgcgtcgcgctggcgttgtgtggctttctatggcgcgtgaggtctatggcagtgatacgccgatgcgtatcgttaatgaggacggcagcgatgacgtggcgttgatgactggtgaagtggttgaccgtcagacagggcaggttatcgcgcttaacgacctttcgcagggtaactatgaagtgactgtcgatgtcggtcagtcgttcgctactcgccgtgatgcaacggttaagtcgttactttccatgctggcacttatcccaccaggaacgccgaagcacgatcttgtatcgtcgatgattctcgacaatatggacggcgaagggatggacgaccttaaagaatacaaccgcaatcagttgcttctgtctggcgttatcaagccgagaacgcctgaagaacagcagatggttgaacaggcgaaacaacaacaggccagtcagccagatccggctatggttgctgcgcaaggtcagcttcttgctggtcaggctgaattgcagaaagcgcagaacgagcaggcagccattcaggttaaagcattccaggcacagactgatgctcaggttgcagcggcaaacgttgtgaaaatcctcgcatctgccgatagccagcagaaatctgatatccgcgaggctctgaaactgctcggacagttccagcaacagcaaggagataatgcccgtgctgatgcagagcttgtcctgaaaagtcaggcacagggccatgcgcagcgcatggacatcagcagcatcctgcaaaaatcaactcagcaacaaccacagcagtaattaacccataacgtgcaatggctgtctttatgaggcctggcaccctattgccttccgatgggctgaacatcgagtaaacaggggtaacaaatggaccagatggcagaaaacacaccagaagttgaaatcgaaaccgacgcgtcagagcagattcctgatgatgtcgaactggctgaagaagtcgaaacagaagatggcagtgagtcctccggcaatgatgcagaggaagctactgaaactgatgacgacgaatcagaacaggaattctactttggtgacgaaaagctggattcgccaaccagcgaagatggcgcagagcatggactggtaaaacacctgcgcaagacgattaaagagaaagaccgcgagctgaaagagctgatgcgtcagtcccagaaacccgtcgagcagcagccggtaatcactcaaccaccgcgaatgccaaaactggacgatgaggacatcggtttcgatgaagaaatctaccagcaacgcatggctaagtgggcagaggataacggcaagtaccagcaacaggagatggctcgcaagcagaaggagcaggagcttcaggctgcctatcaagagcgattatccaaatatcagcaacgtgttaaggctctcaaagttcctggctatcaggaagctgagcaggccgtactcgaggaaatccccatcgagacacaaaacgcgatcctgtttgagtcagagaagccggaaatcgttgttctggcactcggtcgcaacgctgaactgcgcaagcaactggcagaagctaccaaccccgtagcaattggtcgtcttctggaacgtatcgaatcgaaggccagaatcatgccaaaagcaaaaaccacggcagccacaaccccgacagttaaggggagcaacggcgcagtaatcaataacctcgacaaactgaaagccaaggcgctggaaactggtgactggacgccgtatttcgccgctaaaaaggcaaaaaaataacctatcggagcattaagcatggctaaccaattagcaaaagaccttgaaatcatgttcgaaaactacgttgaaggctttgaggccgcctgcgtagtttcccgtaacgctaaaaaattccgtcccggtgatacagcaatgcagcgagcaggtgatgttctgtatcgtccgcagcattaccacatgaacattgaggaaggcctcgatctcagcagcaaaacgccaacagcactggttcagcgccttgttccttctgtgttcaaggagccgaaaaacattctgtacactctggatgcgcgtgaaatgcgtgacccggaacataaaactgaagctggtcgcgccgcaggtatgcgccttgctgcacagattgactctgacctgatttccatggttacgcagcgtgctactaacgtgatcacgatggctgactcaaccacaggttcacagggccgtgatttgtggaactgtgcggcaggtattgatgccaccatgacggcgattggtgtacctcagggtatcaaccgtcgctctttctggaaccccttcaactacaaagaccttgctggcgagcttggtcaccgtgcctatgctcagggcacaaccctgacagcatacgaaaaagcgcaaatccctccggttgcgtccttcgatagctacaagaccgatatttctggtcgtgttccgaagggtacagcaacttccattacgctggcagcagcacctgcgcacaaggttgaagccaaagatgctaacgatatgccagtggataaccgacaggggaccattacggtatctgctgaaggtttgcaggttggcgatgcgtttaccatcgcaggggtgaattctgtacaccagatcaccaaagataccaccgggcagccgcaggtattccgcgttctggcagtaagcggaacgacagtaactatctccccgaaaattctgccgcctgacaacgcggatgtcgccagccgaccatatgcaaacgttgatgctaatgcggcaagtagcgcagcaatcaccattctcaacaaaaatgccgcaccggctaacctgttctgggctgatggttctgttgaactgatgtacggcaagctggcgttcccgactggtcagggtccacaggtaatgacagcaaccaccgagcagggcgctacgctgatcatgtcttacgccttcgaccacatcaaaggtgtaaccactgcgcgtttcaccaccctgtacggttgctctgtacttgttcctgaatatacgggcatcgttattgccgggcagtaattttggtggggcttcggccccatttttattgggagaagacaatggcacgaacaatgctctataagcctggcaacatgatcacctgtggtcagtttgctgtcgattacatcattgttgatgacgaagaagttaaatctcacctgaaaaaaggttgggtaaaaactcctgaagaaaccgcaacgaagcaaaaagtggctaaggcggaagaagatggcgaaaacgaagggtgatctcgttctaaaggctttacgaaaagccgggctgtattccaatgccacgttgacagatgctgaccctcaggcaattgaagatgccattaatgacctcgaagacatgatggcagcatggcaggcgaaaggtatcgagcttgggtatcagtttgctgatacagaaaacggcatcatgccgttacctgacgatgattcaggtatccctgcatgggcaaatgatggcgtcgctttgaaactcgctgtgcaagtgtgcatggataacgtcattcagccgtcagacgctctccttaccgctgctgacagtgcatatcaaacaatctgtatcgctttaaccaaaataccaccacttgagcggcgaaatgatatgcctcgcggtagtggtaacaaaagcgcgtttacgtggaatcggttttacatcgagaaagatgatccgagtacgtgaggtgaataaatgccgattcagcaacttccgcttatgaaaggtgtcggcaaagacttccgaaacgccgactatatcgactatctgccagtgaatatgctggctacacccaaagaaatcctgaacagcagcggatatcttcgctcattcccgggcattgccaaacgctctgatgtgaacggcgtatctcgcggcgtcgagtacaacatggcgcagagtgctgtttatcgcgtatgtggtggcaagctgtataagggcgaaagtgaagtcggtgacgtcgccggaagtggtcgcgtatcaatggcgcatggtcgaacatctcaggctgtaggcgttaatggtcaactggtcgagtatcgctatgatggtacggttaaaaccgtctcaaactggcctacagacagcggattcacacagtacgagttaggttcagttcgcgatattacgcgcttacgtgggcgttatgcgtggtcaaaagacggcactgattcatggtttatcactgaccttgaagacgaatcgcatcctgaccgatacagcgcacaatatcgtgctgagtctcagcctgacggcatcattggcatcggaacatggcgagacttcatcgtctgctttggttcatcgacgattgaatatttctccctgactggtgcaaccaccgttggtgcagctttgtatgtcgcacagccatcactgatggtgcaaaaaggcatcgccgggacttactgcaaaacgccattcgctgattcttatgcgttcatcagcaatccggcaactggtgcgccgtctgtatacatcatcggctccggtcaggtatcaccaatcgctagcgcgagcattgagaaaatcctccgctcctacactgctgatgaactggctgatggtgtgatggaatcgctgcgatttgatgctcatgagttgctgattatccaccttccgcgccatgttctcgtgtacgacgcatcttcaagcgccaatggtccgcaatggtgtgtgttgaaaactggcctgtatgacgatgtgtaccgcgctatcgacttcatttacgaaggcaatcagataacgtgcggcgataagctggaatcggtgaccgggaaattgcagttcgacatcagcagccagtacgacaagcaacaggaacacctgctgtttactccgttgttcaaagcggataacgccagatgcttcgatctggaggtggaatcatccactggcgtagctcagtacgccgaccgcctgttcctctctgcaaccactgacggcataaattacggacgtgagcagatgattgaacagaatgaaccgttcgtttacgacaaacgtgttttgtggaagcgagtagggcgcatcaggaaaaatgtcggcttcaaattgcgcgttatcacgaagtcacctgtcactctgtctggctgccagataaggattgagtaatggcggattcgaatctcaatgtgccggtaatcattcaggctacacggctcgacacatcagtccttccacgcaatatcttctcgcagtcgtatctgctgtacgttatcgcacagggcactgatgttggtaacgtggctaacaaagccaacgaggccggacagggcgcttatgatgcacaggtcaggaacgatgagcaggatgtcacccttgcagaccatgaatccagaattgaagctgctgaagcaactctcatcaatcatgaacatagaattgcagcagcggaaagcactcttgcagaacatgaaacaaggattacggatgctgaaacagagctggctgatcacgagacgcgaattgctgccaatgaatctgagttagcaaaccatgatgcgcgcataactcagaatacagccgatatcgacgcacttgataccaggctcacagcggcagagggaagtatttcgacgctacaaagcacagttggtgatcactcaacaagaatatctgcgcttgagtatgccaccactcgcaagaaatcagaggttgtttactctggcgtatctgtaaccatcccgacagcgccgaccaaccttgttagcctgctgaaaacgctcactccgtcatccggcacgttggcaccattcttcgacaccgttaacaacaagatggttgtgttcaacgagaacaaaaccctgttcttcaagctgtcgattgtcgggacgtggcccagtggaaccgccaacaggtcaatgcagctaaccttttccggctctgttcctgacacactggtaagcagtcgcaactcggcgacaacgaccgataacatcctgttagctacgttcttcagcgtggataaagacggctttcttgccacaaatggcagcacgttaaccattcagtcgaatggtgcggcgtttactgccacaaccatcaagataatcgcggagcagtaatgattcagttcaaaccaacgcgaaacatcgacctgatagaagccgtgggaaatcaccccgacattatcaccgggagcaacaacggtgatggatacgactacaagcctgaatgccgttacttcgaggtgaacgtgcacgggcagttcggcggcattgtttactatcaggagattcagccgctgacattcgattgccacgccatgtacctgccagaggttcgtggattcagcaaggaaatcgggctggcgttctggcgatacattctgactaacaccaccgttcagtgcgtaacatcgttcgctgcacgcaaattccgccacggtcagatgtactgcgcaatgattggccttaagcgtgtaggaacaatcaagaaatacttcaaaggcgtggatgacgtgactttttacagcgccacacgcgaagaactaatcgacttcctgaatcacgggagatagccatgttatatgcatttaagctgggcagaaaactgcgcggcgaggaaccttattgccctgaaaaaggcgggaaaggtggcagttctgataaaagcgcaaagtatgcagcagaagctcagaagtatgccgcagacctgcaaaatcagcagttcaacaccatcatgaacaacctgaagccgtttactcctctggctgataagtatgtcggcagcctcgagaacttatcgtctctggaagggcaaggtcaggcacttaaccagtattacaactctcagcagtataaagaccttgcaggtcaggctcgctatcagagtctggcggcagcggaagcaacaggtggattgggttccaccgcaaccagtaatcagttagcagcaatcgcaccaacgcttggtcagcaatggctatctggacaaatgaacaattacaacaacctggcaaatatcggtcttggcgctcttcaggggcaggcaaacgccgggcaaacatatgccaacaacatgagtcagatttcacagcaaagcgcggcgctggctgcggcaaacgccaaccgaccgtcagcattgcagcagggtgttagtggtgctgcatccggtgcgcttttgggtggtggcatagccagtgctctcgagctatcaactccgtggggtgctggtattggtgctggtcttggtctgcttggttcactgttttaaggggtaatcaatggctacgtggcaacagggtattaattctggtgggtttcttgctggcatcggtgcgcaaaatgagaatgcgccaaaggcaagcgacattaacgcaacgcttggtctgatccgcgaaaacaatgaactggctcgctcaggtgcaaataacgttggtctgaccgcgttacgtggtctggctggagttgctgatatttacaagcaggaacagcaacagaaagcgattaatgcgttcaataaggttcatgctgatgcatgggcttctggtgatccatcgggactatttaagtttgcccaggaaaatccagcgtttgttgcacaggcacaacaggcgttttctggtcttaatgatcagcaacgcaacgatatgggcgatttagccatgagggctaacgtcgctctttctcagggaccggaagcctacagtaaattcattactgacaacaaggacaggttaaatcgcgttggtgctaatgctgactggatgattcagacaggtatccagaatccagagcagctatcacacatgctgactactatgtctctcggtgcgcttggaccagaaaaggcgtttgctgttcaggataagatggctggtcgtgaaattgaccgaggcaggctggcagagacaatccgcagcaatcaggctggcgaggcacttcaggcgagagggcaaaacctttcctatcagtcagcaatgactggacacggacttgcagcagaaagactggcacttgataagcagaaattcggttttgaagtacaacaggcacaaaagaaggccgatgaacttattaatgctgcgccaaaactatccgtgaacatggaaaaggctatagaaaaatcagcaggtgatgcggcagctagtcgtaatgctgccgattcaatgacaacgcttgctgacacgcttgagaaggagaagccaactcctggtttgttcggtaacgctgaaaatatgttcactaagcttacggggcaagataactacctccgagatatgcggattagattcaaccaactagccaatgcgcaggcaaccaagcttctcccccccggccctgcatcagataaggatattgagtttgcaaggaaaggcattccaagcgaaacggataatccaatggtcatggctcgatggttaaggggtatggcaaaaatggaaagtaataacgcgaagttcaacgagtttaggtcagagtggatgagtgcaaatggcagcccaggacaatctgatcgcaaccgaaacatcatggggatggatgttaagaagggtgaatcattgaactctgcggcaaaacgttttctttcctcaagttatggcgatagccaacctcaacagcaattgtccgatgacgaattaattagcaaatatctcggagggcagtaatggcctatagtcgtgaacagttgatgacggcgttaaggaatgctgatgctgccggcgatactgagggggcacgtcgcattgctcagatgctgtcttctggtgatcaatccactcaaaaccaatcgcagccagaagaacaatctctggtgggaaaagctactgactggctcactggtggtcaaagtgcagggcaaattgcagaacaggctggccgtggtctggtaaacataccatttgacgtattgcagggtggcgcaagtctgattaatgcaatcagccagggtcttggtggccccaaggttttggatgatgtttatcgtccagtagatcgaccaacagacccttatgcgcaagctggagaaacaattggcgggtatttagttccaggagttggaacggcaggaagcatggctattggatcactggcagaggccgcaaatcagaaaggcgatttcgcacaaaatgcagccaaaaatgccggagttaaccttgccgctcagggtgttctttccgcagcagcaaagggaatagggcgtggaataacggctataaaaggtgatattgcgccagaagtggcgaagaaaattgccacatcagaatcgatgggcgtgacaccaatgacatctgatgttatcccgccgaaaaatgctttcactcgtggccttactcaggatgccgagggggctttgctcgggacaggctcaaagagagcggagcaatatgcaacgcgtagtaaactggtaagcaattattttgaccgttttggtgagtacaaccctgatgatgtggtgaaatctcttaccaccacgttaagggggcggaaggatgccgctggcgctgttatcaatgacgtcaccaataaaatgggtaatgccgcagttgataccacaaataccatgaatgctctgaatacagcgatcgcaagacaggaacggcttgggacgtctgccaatcaaagcctgcttacatccttgcgtaacctacgtgaagaattagcaaaccctgcaactgatttggatgttacgtttgatctcttgcgtcagcacagaacagcatttagatctaatgttcagggagatgctatggtcttccccaaccaggcaaaagcagctaccaatatggtagagaatgcaatgtcaaaagaccttcgtaacgcagttgctaaaaacctcggtgcatcagacgcagcaaaataccttaaagcaaattccgattatgcaaacgtttataataaggtgcttaataaaaacattgccaacaagctcaacaaggcaagcagtgaagccagtcctgaacttataaataccgttgtattaagcagaaaaccatctgacgtgaaacgaatctggagcgcactggatgataaagggaaagatgctatgcgtgcagcttacgtcagcaaaatagcggaaaaggccggcgactctccagccaagttcatcactgaagttaataagctgaaatctcagtcaggaggtgaaatttacaacactattttttctggaaagcacatgaaagaacttgatgctcttaatgaagttctacagcaaacagcaaggtcagacaccgcaaatgtagtaactcagacggggcaatcgcaagccaacaggataaggacgattggcgcaactgcgactcttggcgtatcaatggggcttgaggctggtttcggtgcaatgatgcgcttgtatgagtccaaagcagcaaggaatgcgctcttacgtctggcaaacactaaagctggaacgccagcctatgaaagagcgctgaataacgccgcaaatgccatcagaccaatacttgccaatgatgcaactgatcgctaagggttgatgtcatggatgttgttaattgcgaatggaatcgcggaactctttgcttgatagaaaaggatctgttctccttaactcatcatagtttttattaaactttcttgcttcacctgggtatctgttgaacaaaacattgcagaaaaaagagagcaataactcacatatgaatgctaataccctgaaaaataaaggtataaaaagaagggaaggttcattgaagtctctattccaaacaaaatagacaatcatcccgacataccaaattgatatccctatactgatgattgttccaacagaggtaactacgatcccgattaagtcggacagtctgtttgccagtaactcatttgagtatcttgcaatcatataccgccaacattttgcaatatcatcctgatctgtagagtcttctggaatagctaggcttctacatattgaagtagctctttttttctcaactctttttgagatccatccattaaagagatacatcaacacctgcgttgctattcctgcaccaagtgatatcaaagacatccccaaaaatctccatcctggagatagtgactggtactgccaaacaaaaaaaattaaaaaacccaatgagcctatgacataggctgatgtatcgctatatatatctatttttttcattgagtagccactccttagttttgagcagaacaccggatgataatgtgtcgcttcctaaaggatatcaaagcaacgggatttcaaggtaaactgcggttgccaaaatactaacatcttcatttctaacaagaatattaggatacattgggtttagggatactaagtttgtctctatttcaccaatgtaaacctgcttgaagctcaatatttgctctttatccaatgatgctattacataatctttgcttttagcttttactagagggctgaacgtgacaactgatcctctgggaaagctaatacctgaacttgtagtcatagcttcaccttcaatagtcaatgcaaatgcagagtcaccaacattgtatattgccggatgaaatctagacgatgaatgttcacctgtgtttaggtaatgcataacttcatctagtttgaggattggtatttgctttaccagaacgtcaggcatgacgttttttgttccaggcccctgaccttcacccagagctaaccactcagccgtagtgcctaatgcgttggctaatgcctgcaatacacgaagccgtggtttagcctcaccaccctcgtatgcagctatttgacgttgaacaacaccagctaattttgacaactgcgcctgcgtcatacccctggactgtcttgccagagatactcttgatgggaattgatcgtcaaaattcattagttcaccataaaaaattcattgactcatactgagtgtgagtgaataatcaaactacaaaaagtgagattatgagtttttcaaaaacaggagtgcataatgactgaaaagatatcttccatcaagccgcgtcaggttcgttttacagaaaaggttgattcacatatccgcgaatcagcaaaaagatgccataggtcaattcaggcagagatagcttatcgaatggagttattgatgaaacttgaggcaaagggcgatgttgtcatccaataaaaatagtgaagcccggcagtgcgcgaacacaaaccgggcctctatgtcagtaaccgtatgcaaggaaactaacatgaatattgtagcaaaatcagattacaacttccacggagttgagttggtgcccacccgtgatatgcatggtgtttggtttacatcatctaatattgcatctgcacttaaatatgcaaatagccgtgcagtaacaatgatttataacaagtatagcgatgagtttagcgccggaatgactcaggtactcgaagtgagtacctcaggaaattatcgcaaaaaagtgcgagttttctcactacgcggtgcccacctaatcgcgatgtttgctcgcactccggtagccaaagagttccgccgctgggtgctggatattttggatcggcaggcagaatgctcaccgattgcaaaacagtttactgacgaagaactggttaatctctgctacttacaattgtggatggagaagagtcaacaaatgtgcaaacacatctacccaggaatgaagcaaattggttctgagctttcaggaagaatttacgatattgcatatgagactcgctatatgtcagaagaaaccaagaaatcacttcttcgtgaaatgaagaatcttgataccaacaattttgtcgtaaagaacgctcagccaatgctgacaaaactgcgcggcgaggaatggattcattgattggtgcgccggacggcgcaaaaagaaaaccgccagtgtgctgctggcggcctatgtcacacccttactaccacataaggaatgcctaatgactttgaagaatgtagcaaacatcggatccgttgtcacggataaaaccattgacagccaaagtcttctgatgatggttaatgaagctcgcaagttatgtggagagccatcagtacgtaacaacaaattcatcgagaaaattgaggatgaattggagggcgagacctacacaaaaagtgtaggtcggaaaaacggggctgacattgatgttatctccatgactatcaagcaggcgcttcgtgttgctgctcgcgaatctaaagcagttcgccgaacacttgtagacaaacttgaaagtatgcaagaagcgcacattaaaagcggtaaatcgtcgagtggacttgttgagtatcgccaggctcgaacattgaaaatgacggttgaagctgttaccaatctgttagatttgatgccaaatcttgcgccggaagcaaagcagactgcggcagcaagcataatcaacccgatagttggttttaatgcaatacctcttccagcaatagaagagcattactactcagcaggggaggttgcagagcagcttggagtaacggcaaacaagattggtcgcattgctaacgcaaacaactgaatcgccacgggtttaacagacacctcagagtcatttaagatggcttaaagagaggtgcccatgagcggtaagcgttatcccgaagagtttaaaactgaagcagtcaaacaggttgttgatcgcggttattctgttgccagcgttgcaacacgtctcgatatcaccacccacagcctttatgcctggataaagaagtacggtccggattcttccactaataaagaacagtcagatgctcaggccgagatccgccgtctccagaaagagctgaaacgggttaccgacgaacgggacatattaaaaaaagccgcggcgtacttcgcaaagctgtccgactgaggtacgcctttatccgtgacaactcctgttgctggcctgttcgcctgctctgtcgggtgctggatgttcatcccagtggtttttacgcctggcttcagcagccgcattcacaacgccatcaggcagacctgagactgacaggacagattaaacagttctggctggaatcgggatgcgtctatggttatcgcaaaatccatctggatttgcgtgacagcgggcaacagtgcggagtaaacagagtctggagactgatgaaacgtgtcggaataaaggctcaggtcggataccgaagcccgcgggcacgtaaaggcgaggccagtatcgtgtcacccaacaggctccagcgacagttcaatccggatgctcctgatgagcgttgggtaacggacataacctacatcaggacccacgaaggctggctgtatcttgccgttgttgttgatctgttctcacgcaaaattatcggctggtccatgcaatcccggatgacaaaggacattgtcctgaacgcactgctgatggctgtatggcggcgtaatcccgaaaaacaggtgctggttcattcggatcagggcagtcagtacacaagccatgagtggcagtcgttcctgaaatcacacggcctggagggtagcatgagccgtcgcggtaactgccatgataatgcggttgcagaaagttttttccagttgttgaaacgtgaacggataaagaaaaagatctacggaacgcgggaagaagcccgcagtgatatttttgattacatcgaaatgttttataacagtaagcgtcggcatggttctagcgaacagatgtcaccgacagaatatgaaaaccagtattatcaacggctcggaagtgtctagattatccgtggcgattcaaacctcaaaactgagcagtacgggaagttcttcctggataaatcggcgcattccagcaaacaggtagaggcgttccgttacaattctgaaggcgttaaagcactacaacacctgctacatggctcaaatgtggcgtaacattttataatgaaaactaaacccgcttaatcgcgggttttttctttccttagaatttcagccgcaacttcttttactcgttccgagattaatgaggccagcctctcttcttcatcacgatacccgcttacaggtgatggtttggagagtgattcttccatcgtagccacaatttcagaattgatagacctgttattcatttttgcacgctgcttaatcttagcgtgcaactcgtgtgtaagcctcaagtggaactgcgcctcatcgtatttgctgtacatcatcaatgcctcaccaaatgggtggaatggcatcgtaacctactggataaatcaacaatcgtaccatttcggtatgtaactatagcttaccgcagctctgctgtggggactaattgcgccaggagcacatcaaatgactgacaccaattacctgatctctatgccgtctacacctttttcggcgccacgagcatttaaatcagtggcgaacgggaaaatctatatcggaaaccctgacactgacccggtaaatcctgctaaccaaattccggtatatgccgttaatgagaatggatccgaggttcaggtttctcagccaatcatcattaacgctggaggcttccctgtttataacgggcagattatgaagttcatcaccaaacagaacttcagcatggcggtgtatgatgcatatggggcgcagcagttttactggattaatgttgcaaatatggacccaaactctgcgtatctggaagcggttaatgatgttcttgcaatgctgggctcaagcgatggcgcaaaactgataggtggaatgagctttcttacagcggaaatgtactctcatcttgttgaagggatggactggaggaaagcaattcaagctgctatagaccaagctcaccagaactatttagccggaagcggcccaaccaatattctcattggaggtgaattctccgttactctcaatcctaattcaactttgatacctggtgaggttgctgcgggtcgaggtgcgctgtgtatgcgtagtggtgtaacactgatgggcggcggagcaatcacgcttgatggcaattttactggctcagccagcggcgcaatcattacaaactgggaaggcgccgccgataactgcaagattcaggggatcacgcttaacggcagccgtggcaccgctgccggaacggggattacctgcattaatatcttggactcggataatgtcactattgataacgttaaggcgatagatagcacttctggagggatttatttacgccgagctaacaatacggtttatggctgttctaactcaagaattatgaactgctacgttcacaacgttgaatatattggcattcagtgtgaacgccccaacgggatgaccattacgggatgtgccgtagcctcctgcggtgataatggcattgatatctttggtaacgtaactgacgaatctggacagggagttgcggaggatgttgttgttagtaataacactatccgtgatgtaagcgtaggagtgttcatcgaatcatgcggaaacgtggcaatatcttcgtgccgtatttcaggatttagtaactctggtgttttctttaaccggataaatacagctgcgtataattgttctgtaattggatgcacgataacaggggcggatattacctccagccagggcatccgctggaagaatgcagttggttacactcgcgtttataacaacacactaaaaaactgtattgactcctttgtgacaactggagggatgatttacgttgatattggggtgaataaccatgaaagcattggcaggtgttttctttacgttcccaaaaaatctaacggatgtgtctatacaagaatggttcagcaggtctacaacggagttcagacagatggcataccgtacaacacgacacctcgtggttggccatccgcaaacaacactaggtactatcgctgttcattcaccgcgccgtacatgatgtattccgctacgactggggaagataacctcattcgggctacaggcaatttgccattcaacagtggctgggggcctgcttactcgctatacaatacgattgtttctggagaaacagtaatagccatggggagctcgctactgtctgccggtgaatacatgctaataaacggttattattatttagtttatagcgtcacatcatcctatgctgtagtaaggaaatgggatgtatccagtcaggactatattgccggagactacacatcttatttaaatagcgcatacgcatattccatcttcagagctgcttggggaacactatgacttacatgaaaggtgattacatatcgacgaactctcgctatggcgaatcgaaggtaggatgttttgcctacatagatgacaccgtgaaagatggagatctttatatcagtgctatcggaatttatgatggagagggcaaggaaaataaaatattcgatttcaacgtagtaactctcagtggagaacctgatgatgtgttttctttggctaaagaaacatacctgagcaatttctcaataattgattaataatcaccactaggctttgatggcagagcatttaaaccaatgaaccttccagtgccgtagccaatacttcaacagatggaattcattggctgaacgccaacaaagtcatatgattcagtaacatttccggttactaccattgatagtcgcaacatctattgatcttcccttacagtaaaactactgtatataaaaacagtaatcatcagagggaagatcatgcaccgtcagtcagacatctatcaggctttccgcgagtcggtattgcgcaactccaaaggctaccagtatctgcatacaaaggattttgtgtcagcgctgctccggcgtgggctgcactttaccgactcagaggctaatgcgtggatatctagagagcagacgtactttgtcgacaaaaccaccgaccatagcgaaaaccgtttgtggatgatggctaacatggggagggttttgtaatgggctttccttcacccgcagcggactacgtcgagcagcgactgtccgttaactcgatatgcaatgttggtcctaacacccgcgttttcgaaagggatggcggttatgttgtgctggatatctccctgaagccaaagcagggtagtcaggttctgatccagcacggcggcgggactgagcttgccacgttgagagggagggccctgattactgaagacggcgaagcgattgaaggcgaggccctggatgatatcactgtcgccggcgtggtgacacacaccatcatcgatgtgagaagtgacagcgtagcggtataaggcaggctttttagtggcctgccgcttttgattactgtgtcttttcgtccagccagtccgcccaccactgcatcatttctctgcgtttatcgagatactgagcatggttgtatattccacgcacagatccgccgttggcatgagcgagttgcacttcgatagtttcgtgatgcaccaagtgatcaaagtaatgaaatttaacatccaagcctccatcgatcgatacttgcggtagttgataaggaaaaactatggtacacaaagcgttgcactggattgcaaggctttgtgctcttctgtggatgtgtggctacatgtttgaagatcgttgtgccgaatttgtgacatacacatgacaacatcatgcatcaactttctgtttgtgccatcaactatagcttagtgaatgcggttaatgcttgctaaaacagatagttatgattggtgctacagattcgtaatgcgaaggtcgtaggttcgactcctattatcggcaccatttcaaactcttcccaagtctaccgaaatcaactaaaagctcgtatactgcggtttctggcccgtatcttatctcctgttatcaactagactcaaccgaaatcaagtcgcagttgggggcataagtgggggcattttgtgttcggtctagggagatgcccccaatgaaacttaatgcgcgacaggtagacgcagctaaacccagagagaaagcctataagctggcagatggtgctggtttgtatcttgaggttgttccctctggttccagatactggcggatgaaatatcgcttcaatggaaaagagaagcgtatggcctttggtgtctatccggcagtgtcccttgcacaagcgagggcactgcgtgacgacgccaagaaaaagcttgccgaaggtatcgatccatcgcttgccaagaaagaagaaaagctggttcgagatgtgcagctaaataatacgtttcaggctgtggcacttgaatggcatggaacgaaggtgagccgatggtcagaaggttatgcctcggacattatcgaagcctttaataaagatatttttccctatattggccaacaaccggtgaatgaaatcaaaccgctggttctgcttaatgtgctgcgtcgaattgaaagccgtggcgcgacagagaaggccaagaaggttcgccagcgttgcagcgaagtctttcgttacgccatcgtaaccggtcgtgcggaatacaatcctgcagcggatcttaccagcgcgatgtcagggcatgaatcgaagcattatcccttccttactgttgaggagttaccagacttttttaaagctctcgcaggctacacaggaagcccgttagttgttcttgcggcacgtctgctgatcctcacgggagttcgcactggcgaactccgaggtgctttctggagtgagtttgatcttgaaaaagcggtgtgggagatacctgccgagcgtatgaagatgaaacggcctcaccttgtccccctctctacccaagcgctggaaatcgtacagcaactcaaagtgatgtcagggcaatatccactggtgttcccgggacgtaatgatccccgcaagacgatgagtgaagcgagtattaatcaggtttttaagcggattggatatacggggagggtaacggggcatggtttccgtcacacgatgagtacgattttgcatgaggaaggtttcaatacagcgtggattgaaacccagctggctcacgttgataaaaatgcgattcgtgggacgtataaccatgcgttgtatttggaaggacgtagggagatgatgcagtggtatgcggactatataaacgctaatcataattcatgtatttctttgctggtgaacgctacaaagtagatttgacgtgatgataggattgattaggaaaatgacctaaaaccgtatattttgatacttaagtttaaacattagccctatatccgatcgccctttgttacctacacttctatcttttttaggttctagggctgaaagatttgaagataagtttataaatatcaatagattacatgattgtgttggttcttgggtagccgtaacgcctagggcggtagcgtacttaagatgagtataaaaaatgaacagtaactatatgccattcacacaacgagatagtctcggaagatactatacaaaagaatccataagtgcattattggtttctcagatgaaagctgaaaaagtcaataatattattgatttagcttctggtgaggggagcttaacctatgctgctttagaccgatggaagaatgcagaagcatattctttggatatagaatctcggatgtcaaaaaaagtatgtgataatcttactcatattgtaacagatgcccttgttcattcatttcctgaaatgcttgcccgacatcaaggaaattttgatgttgcagtatgtaatcctccattcactctccctgaatggagggatgattattttaaaatcattagtgagattggcgcagataaatatatatctgtctcaaaatatgtcccagcagagataatatttatatctcaagtcatcaggtttcttaaaaagggcggtgaggctggaataattttacctgatggtatatttacagcaagaaagtttataggtttaagacgatatttattgaatgaacattcaattacaaaagtcattgaattgcctaggaatatcttcaaaaggacagaggctaaaacacatattttaatttttaataaaaaaattatgcctcatcataaaatacaattacattgtataactaaagatggggaattgtcgcctcctgttttaattagaaaagaagatgcggttgagagaatggactactcttatcattataataaaaatgaaggtaaagggtttagcacaatagggatgcttaaaaatatttcaatttttagaggtaggtttaattcaaaggaaattacggaacatgtttttcatacgacaaaatttagtggtgatgaaaagtacattaaattccactgcaactctgtagaagaattgaagccatcaaaattagatgtcattgctaagcctggtgatatattaatagcaagagttgggcgaaattttcataaaaaaatattgtttgttgagagcggctattcttatatcagtgactgtatttttctgatacgagcctctggtggagataagaaaaaactatttgattttctttgttctcaagatgggcaagaggaattatctcgagcgagtagtggtgtagccgcacaacatattacaatggatgcattaaaaaaaatacatcttgtaaggattaaacatgactgatgtggaattagatagtaattttcttatcgaggaacgagctgattatattgatgaggatacgataaaaaataatactatcagatctggagagtttttcgatattatacataatgctcttatatccccaggcatcaaacttatagttggtcctaggggatgtggtaaaacacatttgatgcgttatgcttgggttgaatgtaaaaacgatgataacgcaccattaccactctatgtttcttttaataaatattttaagttagagccgcttttaaaaaataaaccaaatgcaattgatctctttcataaatgggtattagcaaagatactactctctgcttatgaaattgcttgcgatattgaagattctgaatatcttgatttgtcaacgatactcatagcggataaagagttcctaattaatttaatcgtaaggcttgagcagggtctttcgccatcattagaacaagaaaacattgttcaattgatcagtgtttcttctgtcatatcctcgttgagttcactatgtgattggcttgaacgtaaaagagtcattattttattagacgatgcagcaataagcttaactcctgaatatctttacgagttttttgatattgtacgtagtctaaaaacctcaaaaatagctttaaaggcatcggtttatcctggaacaaccgaatatggcccaaggtttcatgttgctcatgatgctgaaacaattgatgcttggatttcggtacagcaccctaattattcctcagtgatggatgctatagcgcaggcaaggtttcctgggtatgatggcattccggatgacttgaaagagttatttaaattctcagcatttggtattccacgttcttttttgatgatgttaagagattatcaaacaactttaagtcagacaactcagcaaaaatttaataaaataattgaaaggtatgttgagcttagactcagcgaatacagttcactaaaagataagctacctcgattgtttgacattgtttcattaggtgaatcacttttattaaaagtagtcgaattactcaaggaaagtaactcccaatataaagaagagaaacaagtcataatcggtatagagaaaaatgataatgtttatttttctcgactcactaagctattaattgaaacagggcttttttataatcttcctgatatttctcatggtgatgggcgtacttatgaaagatatatacctcattatgctttattaataaaggaaagagtgtttaacgaaggaagtagaggtttttctccttctcagattattcaaaaaatactaagaaagaatgctaagcatcctgtcagaagaaacatttcatcattattcaatgctgagcaacttgcgagacttaaactaactttacctccatgcaataactgcaagactccgcgattgactgacaatcaaaaattttgccatcattgtgggaatcaattgattgatgagtcggcctataatcagtgcatgtctattccactgtcaaaagtaccacatctaacatcttggcaaatgcaaaaactatctgggctggaaaaagtaaaaactataggagatgtattgtctttacaagaccctgggagtgagttaagaaaaattcacagaataggacccaaaattgccaataaaattatggacaaagtgttattacatgttgaagagtttttgtcttaattttgatggcatgtacttgtcaatcgtgtctttcttatctgaaaagtttaatttaaaaagagtcgggaaaatggaactagaatcaaaagaggattatgaagagaccactcatcataatgtggcgtcctcagttgtcactgcaacccatgataacttagatggaagagagttttttgaactatgtagtaatccagctctagttttttcgtttgagacacacaaaaaatttaatgagttacctgttgatagcaaggaatccccgttagatctttttatagctaatacaaagcaacttcacttgttaagatctggtgatatttcaaacacattaagccatctgttgttattaggttatgtgtctgcagccgaaagttatttgcgagctcttatcagaaatctaattaatcatgatgaatatatacagtctatagtttctgataaggccgttagttatgcagcggcacaacaccataaaaaggagttattaccagaagctttacttgaggacttttcattggcaagcccttataatgtttttgaaacattaaaggacattattggaatgaaaggacaacgaccaatcgaaatgatgaaatgctcaagcgaattcatgaaagtttgcgagttaaggcattgttgtgttcatcgatttggtaagttgggttcgaaaaatgcaatccgactaggattggctgaacatatgaagcacttagaaaaaccgataatactcaataatgatgatctcgagcaaatcgcatttattgttgagaattttattagaactttgaataataccgttttcaaatttataattaatcgtacagttgagaacaaaaataaggaaaaaggaggggaaagactatatgattctgaatggacatgggtgtttgaaaaagatataagtcgatacgaaaagtattattcaatatttagtgccaaaaacgatacccttcccggattatcattacaggattcatatcaactttttgttaatgcatataagcctaaacttcctgcaagaaaaaataaaaaaactgaagaaaattaacgccactactatctgaaaatattagtaatttttacttgaaatggcagggcgttattttttttgattgaatatgggtaatgttaaatatctaatcatttgaaacttctagctatattaataaatgtaatgtgtgaatgatgatggtgcttgctttaactatagattgttattccatatagaaattaggtaatgactccaacttattgatagtgttttatgttcagataatgcccgatgaccttgtcatgcagctccaccgattttgagaacgacagtgacttccgtcccagccttgccagatgttgtctcagattcagattatgtcgctcaatgcgctgagtgtaacgcttgctgataacgtgcagctttcccttcaggcgtgattcatacagcggccagccatccgtcatccataccacgacctcaaaggccgacagcaggctcagaagacgctccagtgtggccagagtgcgttcaccgaagacgtgcgccacaaccgtcctccgtatcctgtcatacgcgtaaaacagccagcgctgacgtgatttagcaccgacgtagccccactgttcgtccatttcagcgcagacaatcacatcactgcccggttgtatgcgcgaggttaccgactgcggcctgagttttttaagtgacgtaaaaccgtgttgaggccaacgcccataatgcgtgcactggcgcgacatccgacgccattcatggccatatcaatgattttctggtgcgtaccgggctgagaggcggtgtaagtgaactgtagttgccatgttttacggcaatgagagcagagatagcgctgatgtccggcagtgcttttgccgttacgcaccacgccttcagtagcggagcaggaaggacatctgatggaaatggaagccacgcaagcaccttaaaatcaccatcatacactaaatcagtaagttggcagcattacccaaaatcaacaagctcagtttcatccagctcaacaaattcaagtattttttctttcgcattttttctttcgcatcggcatcgcggttttgttttttcaaatacgtctgaaaatactcacatgctttcgcaaaactcattgtgtaaatcattgccgcatatcgtagtgcctgtaactccatatgcgtccccgtttcatcacgttttaattcgataaccactatatttgcctgtttatcgattgccaataaatcaattcgccgatggctatcttcccagtcagaaatcaccagacaatcaggagcaataatatctatattttttgattgcttcctgtaatccttccagagtaaaggtcgttttttctaaagcatgtggttctttatttgcgatattgtacagcaccacgttcatcttccttttttaactgattttacagagactttaatacagttaaaattttatttcctgagctgtaatcgattaagttgatgcatttaatgggaatgatatagggtcatttccagtctcacttatagaaatggctaaagcatgactctcgccaaaaccgtttatgtgttgtacataacgcgatcatccctctcacaaattgccttttctcatggcatctcgcccggtcccccattacaatcactttttgttttttgcgagctgcattccagtcttcagagggtttttcgatgattaaaaatgacaaggcatggataggagacttgctgggcggaccgctcatgagcagggaaagccgcgtcattgccgaactgttgctaaccgatcccgatgaacagacatggcaagagcaaattgttggccacaacattttacaagcctcttctcctaacaccgcaaaacgttacgcggcaacaatcaggcttcgcctgaacacgctggataaaagcgcgtggacattgattgccgaaggtagtgaacgggaacgccaacaacttctgtttgtggctctgatgctacattcgccggtagttaaggattttctggctgaagtggtgaacgatctgcgcaggcagttcaaggaaaagttgcctggcaatagctggaacgaatttgtgaatagccaggttcgcctacatccggtactcgccagctactcagattcatctattgcaaaaatgggaaacaatctggtgaaggcgcttgctgaagcgggttatgtggatacgccccgcagacgtaacctgcaggcagtttaccttttaccggaaactcaggcagtgttacagcgcctgggacaacaggacttgatatctattctggagggaaaacggtgatagatcccgttcttgaatatcgcctgtctcaaatccagagtcgcattaacgaagatcgcttcctcaaaaataacggctccggaaatgaaattggtttttggatctttgattatcccgcgcagtgcgaactgcaggtacgggagcatttgaaatatctgctccggcatctggaaaaggaccataaatttgcctgtctgaatgtcttccaaatcatcatcgatatgctcaatgaacgcggccttttcgagcgcgtctgccagcaggaagtcaaagtgggtactgagacgctgaaaaagcagcttgctggtccgttaaatcagaaaaagatcgctgattttatagcgaaaaaagtcgatctggctgcccaggattttgtcatccttaccggcatgggcaacgcctggccattagtacgcggtcatgaactgatgagtgccttgcaggatgtcatggggttcaccccactgctgatgttttatcctggcacctacagcgggtacaacctttccccgctcacagacaccggttcacaaaattattatcgcgctttcagactggtaccagatacgggacccgcagcaacattgaatcctcaatgaagagcataacaatgaatattgaacagatttttaaaaaacctctaaaacgaaatataaacggggtagtcaaagcagagcaaaccgatgatgccagcgcgtacatcgagttagatgaatatgtcatcacccgcgaactggaaaaccatcttcgccatttcttcgaatcctatgttcctgccactggcccggaaaggatccgtatggaaaacaagatcggcgtatgggtttcaggcttcttcggttcaggtaaatcgcactttattaagattctttcttatcttttatctaaccgcaaagttacacataacggtacggaacgtaatgcttactccttctttgaagagaaaatcaaagatgcattattccttgccgatattaacaaagcggtgcattacccgactgaagtcattctgttcaatattgattcgcgtgccaacgtagatgacaaagaagatgccattcttaaagtcttcctgaaagttttcaacgaacgcattggatactgcgctgattttccgcatattgcccatcttgagcgcgagctggataaacgcggtcagtatgaaacctttaaagccgcgtttgccgatatcaatggctcgcgctgggaagacgagcgcgacgcttactacttcatcagcgatgacatggcacaagcattaagccaggccacgcagcagagtcttgaagcctcccgccaatgggtggaacaactcgacaaaaacttcccgctggatatcaataatttttgccagtgggtaaaagagtggctggatgacaatggtaagaacatcctctttatggtggatgaagtcggtcagttcattggcaaaaatacgcaaatgatgctgaagctgcagactattactgaaaaccttggggtaatttgcggtggccgcgcatgggttatcgtgacttcgcaggccgatatcaacgcggcaatcggtggtatgagcagtcgcgacggacaggacttctccaagatccaggggcgcttctctacacgcctgcaactttccagctctaacacatcagaagttatccagaaacgtttgttggtaaagactgacgaagcaaaagcggcgctggcaaaagtgtggcaagagaaaggcgatatcctgcgtaaccagctggcttttgacactacaacaactactgcactacgtccttttaccagcgaagaagagttcgttgacaactacccgtttgtcccgtggcactatcagattctgcaaaaagtgtttgaatctattcggacgaaaggtgcagcgggtaaacaattggccatgggtgagcgttctcagctggaggcattccagacggcggcgcagcaaatctcagcgcaagggctggattctctggtgcctttctggcgcttctatgccgccattgagagcttcctggaacctgccgttagccgcaccatcactcaggcttgccagaatggcattcttgatgagttcgatggcaacctgcttaaaacgctgttcctgatccgctatgtggaaacgctgaaaagcaccctggataacctggtcacattgtctatcgataggatcgatgccgataaagttgagttgcgccgccgggtcgaaaaaagtctcaacacgcttgaacgcctgatgctcattgcgcgcgttgaagataaatatgtgttcctgaccaacgaagaaaaagagatcgaaaacgagatccgtaacgttgatgtcgatttctctgcgatcaacaaaaaactggcatcgatcatctttgatgacattctgaaaagccgtaaatatcgttatccggctaacaagcaagactttgatatcagccgcttcctgaacgggcatccattagacggcgcagtgcttaacgatctggtggtgaagatcctgacccctaaagatccgacttattcgttctataacagcgatgcgacctgtcgcccttatacgtcagaaggcgacggctgtattttgattcgtctgcccgaagagggccgtacctggagcgatattgatttagtcgtccagactgaaaagttcctcaaagataacgccgggcaacgtccggaacaggctaccctgctctcagaaaaagcgcgtgaaaacagcaaccgggaaaaattactccgtgttcagttggaatcactacttgcagaagcagatgtctgggcgattggcgagcgcttaccgaaaaaatcctccacgccatcgaacattgtcgatgaagcctgccgttacgtgattgaaaacaccttcggcaagctgaagatgctgcggccttttaacggcgacatctcccgtgaaattcatgcattactgacggttgagaacgacaccgaactggatctcggtaacctcgaagagtccaaccccgacgccatgcgcgaggtagaaacctggatcagcatgaatatcgaatacaataaaccggtgtatttacgcgatattctgaaccatttcgcgcgtcgcccttatggctggcccgaagacgaagtgaaactgctggtagcccgtctggcctgcaaaggtaaattcagcttcagccagcaaaacaacaacgtcgaacgaaaacaggcgtgggaattatttaataacagccgccgccatagcgaattgcgtctgcataaagttcgccgtcatgatgaagcgcaggtgcgtaaagccgcgcaaaccatggctgacatcgctcagcagccgtttaacgaacgggaagagccggcgctggttgaacatattcgtcaggtttttgaagagtggaagcaagagctgaacgtattccgcgccaaggcagagggcggaaacaatccggggaaaaacgagattgaatccggtctgcgcctgcttaatgccattcttaatgagaaagaagattttgccctgatcgaaaaagtctcatcgctgaaagatgaacttctggatttcagcgaagaccgtgaagatttggtcgacttctaccgtaagcaattcgccacctggcaaaaactgggtgctgcgctgaatggcagctttaaatctaaccgcagcgcgctggaaaaagacgccgcagcggttaaagcgctgggcgagctggaaagcatctggcaaatgccggaaccttataagcatctcaatcgcatcacgctgttgattgaacaggtccagaacgtcaaccatcagttagtcgaacagcatcgccagcacgccctcgaacgcattgacgcccgcatcgaggaaagccgtcaacgcttgctcgaagcgcacgccacgtcagaactgcaaaacagcgttctgctgccgatgcaaaaagccagaaaacgcgctgaggtcagccagtctattccggaaattttggcggaacagcaagagacaaaagcgctgcaaatggatgcagataaaaagattaacctgtggatcgacgagctgcgtaaaaagcaagaagcacaactccgggcagcaaatgaagccaaacgcgctgccgagtcagaacagacttatgttgtggtggaaaaacccgttatccaaccggtaccgaaaaaaacgcatctggtgaatgtcgccagtgagatgcgtaatgccaccggtggtgaagttctagaaacgaccgaacaggtggaaaaggcgctcgacacgttacgcacaacgctgctggccgccattaaagcaggcgatcgcattcgccttcagtaactcccatttcagggcagcactctgctgccctttgcaggattttctatgaataccaataacattaaaaaatatgccccacaggcccgtaacgacttccgcgatgcggtgatccagaagctaacgacgcttgggatcgctgcagataaaaaaggcaatttgcagattgccgaggccgaaaccattggcgagaccgtgcgttacggtcagtttgattacccgttatcgacccttccccgccgcgaacggctggtaaaacgcgcccgtgagcagggttttgaggtgctggttgagcactgcgcctacacctggtttaaccgcttatgtgcaattcgctatatggagctgcacggttatcttgatcacggcttccgtatgttgtctcacccggagactccgaccgcgtttgaggtgctggatcatgtgccggaagtggcagaagctctgctaccagaaagtaaggcgcagttggttgaaatgaagctttccggtaatcaggacgaagctctgtaccgtgaactgctgctggggcagtgccacgccctgcaccacgcgatgccgttcctgtttgaagcggtagatgacgaagcggaactgctgctgccggataacctgacccgtactgactccattctacgtgggctggttgatgatattccggaagaagactgggagcaggtagaggttatcggctggctgtatcagttctatatttcggaaaagaaagatgccgtgattggcaaagtggtgaagagcgaagatattcctgccgccacccagctgtttacgccgaactggattgtgcagtatctggtacagaactccgttggccgccagtggttgcagacctacccggactcaccgctgaaagacaaaatggagtactacattgagcctgcggagcaaacgccggaagtgcaggcgcagctggcggcgattaccccggccagcattgagcctgaaagcattaaagtgctggatccggcctgcggttccgggcatatcctgacagaagcctataacgtgctgaaggccatttacgaagagcgcggttaccgtacccgtgacattccgcagctgattctggaaaacaatattttcggcctggacatcgatgatcgtgcggcgcagctttccggatttgcgatgctgatgctggcacgccaggatgaccgtcgtattctgggccgtggtgtgaggctgaatattgtctccctacaggaaagtaagctggatattgctgaggtttggaccaagctgaacttccatcagcatatgcaacgcggcagcatgggagatatgtttacccaagggacggcactggccaataccgacagcgcggaatataagctactgatgcgtactctggcattgttcactagtgcaaaaacgctgggatcactgattcaggtaccgcaggaagacgaagcggcgttgaaagcgtttctggagagattgtatcgtctggctgttgaaggtgatattcagcagaaagaggctgcggcagagctgatcccatatattcagcaggcgtggatactggcgcaacgttatgatgctgtggtcgcgaacccgccgtatatgggggggaaagggatgaatggtgatctgaaagagtttgctaaaaaacaattcccggacagcaagtcggatttgtttgcgatgtttatgcaacatgcattttctttactcaaagaaaacggttttaatgcgcaagtgaatatgcagtcatggatgttcctgtctagctatgaagcgcttcgtggatggttgctggataataaaacctttattacgatggcacatttgggggctcgagcatttggtcaaatctctggagaagttgttcaaactaccgcatgggtgattaaaaataaccattcaggattttataaacctgtatttttccgtttagttgacgataatgaagaacataaaaaaaacaatctcttgaatcggatgaattgctttaaaaacactctgcagaatgactttaaaaaaatacctggttcacccattgcttactgggcaacattggcgtttattaattcctttcttaaattgcctgctcttggaactcgtgctgtgaaaggactagatacaaacgggtccattgatgtatttttgcgcagatggccggaagtcagcataaattcctttgatgcattagggaaaggtaactcaaaatggtttccgattgcaaaagggggtgagttgaggaagtggttcggaaatcatgagtatatcataaactatgaaaatgatggcattgaattaagaaaaaacaaagcaaacttgagaaataaggatatgtactttcaggaggggggaacctggactgttgtatcaaccaccggtttctcaatgagatatatgccaaaaggattcctttttgaccaaggcggttctgctgttttttgtgaaaataatgatgagctatcgatatataacatcctggcctgcatgaactctaaatatatcaactactctgcaagtttaatttgtcctacgcttaactttacaaccggtgatgttaggaaattccctgttataaaaaacaatcaccttgaagatttagcaaaaaaagcaattgagatatcaaaagcagactggaaccaattcgagacatcttgggagttcagtaaaaacaagttaattgaacacaaaggaaacgttgcttattcgtatgctagctattgtaactttcaagataaactgtatgaacagctagttaatattgaaaaaaatattaataacataatcgaagaaatactgggttttaaaatagaaacaacagagaatagtgagttaattacattaaactcgaacaaaatatatcgttatgggcaaagtgaaaccaatgatacattcctaaacaggcatcggagtgacaccatttcggaactcatctcatattcagtcggctgccaaatgggacgctattccctcgatcgcgaaggcctcgtctacgcccatgaaggcaacaaaggctttgccgaacttgccgctgaaggtgcgtacaaaaccttcccggcagacaatgacggcatcctgccgctgatggatgacgagtggtttgaggacgacgtcacctctcgcgtcaaagagtttgtccgcaccgtctggggcgaagagcacctgcaggaaaacctcgaatttatcgccgaaagtctctgtttatacgcgatcaagccgaaaaaaggcgaatctgcgctggagaccattcgtcgctatctttccacacagttctggaaagatcatatgaagatgtataaaaagcgcccaatctactggctattcagctccggtaaagagaaagccttcgagtgcctggtgtatctgcatcgctataacgacgccacgctgtcgagaatgcgtaccgaatatgtggtgccgctgctggcacgttatcaggccaatatcgatcgcctgaacgatcaacttgatgaagcttctggcggtgaagccacacgcctgaaacgcgaacgcgacagcctgatcaaaaaatttagcgaactgcgtagctatgacgaccgcctgcgtcactatgctgatatgagaatcagtattgatctcgacgatggcgttaaggttaactacggcaagtttggcgatctgctggcagatgtcaaagccatcaccggcaatgccccagaggcgatctaaaccagacggcgcgttcccctgctgccgggttctgcccggtggcaaataccaccgggaaacgcgccgctgctggcatttctccacctcacttcatgataaaatgcgccaccgtgtcaaaatctccttttcgcgttttggcgctttcttattcatcgtaacaacatgggattgtgaacttgcaaaatcaggactttattgctggccttaaagctaaatttgccgaacatcgcatcgttttctggcacgatcccgataaacgttttattgaggaactggaacagctcaagcttgaaaacgtcacgctaatcaacatgacccacgcgtcacagctggcggtgaaaaaacgcatcgagatggatgagccagaacagcagttcctgctgtggttcccccatgatgcgccgcctcatgaacaagactggctgctggatatccgcctttacagcagcgaattccatgccgattttgccgccatcaccctgaacacgctgggcattccccagcttggcctgcgcgagcatattcagcgacgcaaggccttcttcagcactaaacgtacgcaggcgctgaaaaacctggtgacggaacaggaagatgaaacctcgctggataagaaaatgattgcggtgatcgctggcgcaaagaccgcgaaaaccgaagacattttgtttaacctgattacccagtacgttaaccaacaaacagaagacgacagcgaactggaaaacacgcaggcgatgttgaaacgccacggtctggacccggtattgtgggaaatgctcaaccacgaaatgggctaccaggcagaggagccatcgctggaaaacctgctcctgaaactgttttgtaccgatctctctgcccaggccgacagacagcagcgcgcctggctggaaaaaaatgtcctgctgacgccatccggcagagcatccgccctggcatttatggtgacctggcgtgccgatcgtcgctataaagaggcttatgactactgcgctcagcaaatgcaggcggccctgcgcccggaagatcattaccgactcagttcgccgtatgatttgcacgaatgcgaaaccaccctcagcatcgaacaaaccattattcatgcgctggtaacgcaactgctggaagagagcaccacgctcgatcgggaagcctttaaaaaactgctctctgaacgccagagcaaatactggtgccagacacaaccagagtattacgccatctatgacgcgctgcgccaggctgagcgtttgctgaatctgcgcaatcgccacatcgatggtttccactaccaggacagcgccaccttctggaaagcctactgcgaagaactgttccgcttcgaccaggcttatcgcctgtttaatgaatatgccctgctggttcacagcaaaggggcgatgatcctcaagagcctggatgattatatcgaggcgctctacagcaactggtatctggcagaattaagccgtaactggaacgaagtgctggaagcggaaaatcgtatgcaggcgtggcaaatccccggcgtgccgcgtcagaagaactttttcaatgaggtggtgaagccgcagttccaaaatccgcaaatcaaacgcgtgttcgtgataatttccgatgccctgcgttatgaagtggcggaggagctggggaatcaaatcaataccgagaaacgctttaccgcagaactgcgctcgcagctcggcgtgctccccagctacacccaactgggaatggcggcattgctgccccatgaacaactttgctatcaaccaagtaacggcgacatcgtttatgctgatgggctgtcgacctcgggtattcctaaccgcgataccattctgaagaactataagggaatggcgataaaatcgaaggaccttctggagttaaaaaatcaggaagggcgggaccttattcgcgattacgaagtggtgtatatctggcataacacgattgatgccaccggtgacacggcatccacggaagataaaaccttcgaagcgtgccgcacggcggtgactgaactgaaagatttagtcaccaaggtaatcaaccgtctccacggcacacgcatttttgttacggcggatcacggtttcctgttccagcaacaggcgctttcggttcaggataaaaccactctgcaaattaagccggaaaacaccatcaagaaccacaaacgctttattatcggccatcagcttcccgccgatgatttttgctggaaaggaaaggtggcggataccgcaggcgtgagcgacaacagcgagttccttattccgaaagggatccagcgcttccatttctctggcggcgcgcgcttcgttcatggcggcaccatgttgcaggaggtttgcgttccggtattgcagataaaagccctgcaaaaaaccgccgcagaaaaacagccgcagcgccgcccggtggatattgtcgcttaccatcccatgattaagctggtgaacaatatcgataaagtgagcctgttgcagacgcatccggtgggcgaactttatgaaccgcgtatcctgaacatttacattgtcgataacgccaacaatgtggtctcgggcaaagagcgcatcagctttgacagcgataacagcaccatggaaaaacgcgtacgcgaagttacgctgaagctgattggcgctaacttcaaccgtcgcaatgagtactggttgatactggaagacgcacaaacggaaacggggtatcagaagtacccggtcattatcgatctggcgttccaggatgatttcttctaagtgaggcgatatgcaaacccatcatgatttacctgtttcaggcgtatccgcaggggaaattgcctccgagggttacgatctggacgccctgctgaaccagcattttgctggtcgtgtggtgcgtaaagatctcaccaagcaactcaaggaaggggcaaacgtcccggtgtatgtgctggagtatctgctcggcatgtactgcgcctctgacgatgacgacgtggtcgagcaagggttgcaaaacgttaagcgtattctggctgataactatgtgcgcccggatgaagcagagaaagtgaagtcgctgatccgcgagcgtggttcgtacaaaatcatcgataaagtgtcggtgaagctaaaccagaaaaaagacgtttacgaagcccagctttctaacctcggcatcaaagacgcgctggtgccatcgcagatggttaaagacaacgagaagctactaacgggcggtatctggtgcatgattaccgtcaactatttctttgaagaagggcagaagacttcgcccttctcattgatgacgcttaagcctatccagatgccgaatatggatatggaagaagtgttcgatgcgcgtaaacactttaaccgtgatcagtggatcgatgtgctgctgcgctcagtgggtatggagcccgccaatattgagcaacgcaccaaatggcaccttatcacccgtatgatcccgttcgtggagaacaactataacgtttgcgagctggggccgcgtggcaccggtaaaagccatgtgtataaagagtgttctcctaactctctgttagtttctggcgggcaaacgaccgttgccaacttgttctacaacatggccagtcgccagatcggcctggttggcatgtgggatgtggtagcgttcgacgaagtcgcggggatcactttcaaagataaagacggcgtgcaaatcatgaaagattacatggcgtcaggatctttctctcgcggcagagattcgattgaaggtaaagcgtcgatggttttcgtcggcaacatcaatcaaagcgtagagactctcgttaaaaccagccatttgctggcgccatttccggctgcgatgattgatactgcatttttcgaccgctttcatgcctatattcccggttgggaaatccccaaaatgcgcccggaattttttaccaaccgttacgggctgattacggattatctcgctgaatatatgcgcgaaatgcgcaaacgcagtttctctgatgcgattgataaattctttaagctgggtaacaacctcaaccagcgtgacgttattgccgttcgacgtaccgtgtcggggttgttaaaactcatgcatcccgatggcgcgtacagcaaagaagatgtgcgagtctgcctgacctatgcgatggaagttcgtcgccgcgtgaaagagcaacttaaaaaactgggcggtctggagttcttcgatgtgaactttagctacatcgacaacgaaacgctggaagagttttttgtgagcgtaccggaacagggcggcagcgaacttattcctgccggaatgccaaagccgggtgttgtgcatctggtcactcaggcagaaagcggcatgaccgggctgtatcgttttgaaacacagatgactgccggtaatggtaagcatagtgtatcgggtctgggttcaaatacctccgcgaaagaagctatccgcgtcggtttcgattacttcaaaggcaatttgaatcgggtaagcgcggccgcgaaattctccgatcatgaatatcaccttcatgtcgttgaactgcataatactggcccaagcaccgcaaccagtcttgctgcgcttatcgctttatgttcgatattgctggcaaaaccggtgcaggaacagatggtggtgttgggcagtatgacgcttggtggggtaattaacccggtgcaggatcttgccgccagtttacagctcgccttcgacagcggtgcaaaacgggttctgttgccgatgtcctcggctatggatattccaacggttccggcagagttatttaccaagtttcaggtgagtttttactcagacccggttgatgctgtttataaggcgctgggtgtgaattaacgtagtaactattttaatgaactggagaggacaatggctcaagaacgttctgtaattaaattcatcagaccttgcctctccattcatgaatataaaaatacttacatctgagtattgttggctgtgtttgaataaaaagagagctgttcaaataagcctgtataactgttctttacaaaaaatggaggagctatcagctaattcaacactggaagatgttcgtcgagttggattgaacgccctgcgcagaccaggcatttcggattaagtgctcgcacttccacagtcctggaacaagtctggctggtagctgtaaacatactttgtacataccgctctggaatagatccccgtgccacaggcttcacagaactttttcccgggaaaatgctgcccgcacatcacacaatgccactccagcacgaccggtaatggcgataaaaacatcgccatatcctcaatgtaagggtgggacttctccggattcagcaccacacagtccgccttctgttgctcactcagggcatgtaaatcatgctcaaaccacgccccctgagcatctgtctgcagaatcaaccggccatggcaggaaaggcagaaacactgccggatatttctgctgagcgcagagtcggcactgataatgtgctcacccggcgtgatccccagccccgtttttataccgttcattctgctcccccctcctcactgaagcgcccggtctggcagtgtgtgcagtactgctccccataataatcgtggtgacattgcctgcagtgccagctggctttacgtactacgggtaaggcatccgggacgaattgctgcagacgtttaatcaaccgtatttctctgcgttccggcctgacataagggcactcatgaccgtgctccgtcagcccttcgtcagcgtgttcaaaccagggacgttcggtatcgtattgcgggtggtatctgagtgcactgccgcaaaggtggcaggtgtagctatcgtaaggtgcagtctgtgcggtacgggcaccggtcagacgtccgttgccatcaagtgcgagaaaagattttgcgtacatagtatatgttcctctgcgccagacgacacgcaggcaacagccgtcccggtacgggcagcgtggtcagggtgtgaatggcggttcagttaaaatctggactggagtttgggtaaagcaggctggttgctgttacagcactgtggttgtcacacaatggcccactgacgtaaaaaacagtcagtaagcagagatggagattgggggatgtgctgtatcggttgccggaaggaatggtaaagaatgtgtcatggttaaatctccgtatggttcatacggaatgaccacgccgtaaaaaatgcgcagtgccgctgaagtggccgccggaaccgacagcaaagattagcgccagcccgtacttgtcgttcaggggtttacaccagagcacatatccccggcagggggctgtccagtcgtggtcgaccccggttacttttttcaggaagcccgctgcatttcaggatgatgccacattctttctgttcccgtttggccaggtagctgatggcatagcgtaaatcattcaccgctttgtgatctgaatagtgaatgacgtggttaatgtttaccggataatttttattaaaccggcaccagtggtagtaaccattaccctcggtaacccgcctccagatatctcccatcaatctggataccagatacgaactcctgtggctctggccgttcagatagcccacaaaatgaatgtgaagccctttacgttctgtatattccatcacccaggcatacccgaccagtttctctcccacctcgttaatcagttgcagcatctccgcgcacatggcgtacctgcaggcacatctgtagctgagggtgttttttcggtaagcaaaatccattctgaacggtaacagtttcgaatagaccccgaataatgaatccagatgctggttaaagtgctccaggagctggggagccatttcgtaagcgggattggtgttataagtttgcatgtttcttcctcgtgttctgtaacacaggaagaagcgttgccgtaatttttgaagaagatgttctcaggtagtagggtgaacgtgtttcctccggtaacgacttccacgggtatcagaaccaggcaaagaacagcatacgtaacagccatacagcgcatataacgcctgaagctctgttaaccaggctgcagcggaaaggcctttataacgcgtgtgggcaatcactttttccagtgaacaacagaggaacttacgcaggttttaacttccattaccctctcgttatttggtactgtgattaacgtcagaatggcctgacattatcccgaaagtctttccacttccctgtctctccggtaataaaacattttaaatgctgaaggcataacgccataaccagatattacaagtaacgtggcgttacacgtattaatgcattacagaagtaacagaggcaatcggatagtaaacaacactccggaaggctgtttgaatcgccacgggtttaacagacacctcagagtcatttaagatggcttaaagagaggtgcccatgagcggtaagcgttatcccgaagagtttaaaactgaagcagtcaaacaggttgttgatcgcggttattctgttgccagcgttgcaacacgtctcgatatcaccacccacagcctttatgcctggataaagaagtacggtccggattcttccactaataaagaacagtcagatgctcaggccgagatccgccgtctccagaaagagctgaaacgggttaccgacgaacgggacatattaaaaaaagccgcggcgtacttcgcaaagctgtccgactgaggtacgcctttatccgtgacaactcctgttgctggcctgttcgcctgctctgtcgggtgctggatgttcatcccagtggtttttacgcctggcttcagcagccgcattcacaacgccatcaggcagacctgagactgacaggacagattaaacagttctggctggaatcgggatgcgtctatggttatcgcaaaatccatctggatttgcgtgacagcgggcaacagtgcggagtaaacagagtctggagactgatgaaacgtgtcggaataaaggctcaggtcggataccgaagcccgcgggcacgtaaaggcgaggccagtatcgtgtcacccaacaggctccagcgacagttcaatccggatgctcctgatgagcgttgggtaacggacataacctacatcaggacccacgaaggctggctgtatcttgccgttgttgttgatctgttctcacgcaaaattatcggctggtccatgcaatcccggatgacaaaggacattgtcctgaacgcactgctgatggctgtatggcggcgtaatcccgaaaaacaggtgctggttcattcggatcagggcagtcagtacacaagccatgagtggcagtcgttcctgaaatcacacggcctggagggtagcatgagccgtcgcggtaactgccatgataatgcggttgcagaaagttttttccagttgttgaaacgtgaacggataaagaaaaagatctacggaacgcgggaagaagcccgcagtgatatttttgattacatcgaaatgttttataacagtaagcgtcggcatggttctagcgaacagatgtcaccgacagaatatgaaaaccagtattatcaacggctcggaagtgtctagattatccgtggcgattcactgagctgttacgtcagcagcctgcgccacacccatgccggtaaacaccgttaccagagctattgccagaaccttttttttcattgcatttcttcccgagttgaattgaggacgtgatgtcccagtgagtcattttttaaaactaacttgcctggagtttactgaaccaacttatatatttttgagtacagcttggcctcagcattacgccgatgggtatacactgtcttcacactacaattttcaattctggcaatcgatttaggttgcattccctgggccgtcatgcggataatttccatttcccggtccgtgattttatctttcttaatatcttttctcaggaacctgccattaatcacataggccagttcttttctaatatcacgactcagtccagcgtataccacgcccctaatattgctgttgtaataccaataatttgctaaggcttctgactttctggccgcaatcaatacgacctgtttcccctttaccgcggataaccattcattatcacggtttataaattcagataaagaatccgtattgagattgataaacacgaaatcttttctaattttctccaacgatagataaattaatctgtcgatatccacaatcagttcagatagtcctttatagaagtaggcgtcatggggagaccagatgtatttatcagaacggttttgacattccatatggtttttaacctcatagtccctgctgtaatcactttgccatgtcactactttccaaacctgtaatttttacaggtgcattcagtttccttagtaaaccggaagtaaataagatacgtagtacatatcaataaaggttaaacgagattaagtttaattattttcgattgggcttaaatttatgtttttttcccgatgagtgtcaatatgtgaacggaaaaggaattcaatggttaagtcaatatttagaaaaactgaaaatattgcttttttgataagaagaaaaagacatttggtttcataaggttattggcaatataacgttcaattcttacttgcattttatattggtcaggaactttgccctgaagtgttaggaatagtcttaatgcgctgtgtgatggactagtaaaaaaacaagttttaagggtaagggatagaatataaaactataatgagctgtcattgaagatgatttgccaatcagtaagaaattttaatggattaacatgccgcacaaaatggttataggtgttcattacaataagtgatggaaaattgaacgggcgtatgtacgtcatctgttcggtaagcccccaagagccagattaagtgaagttaaacgaaggctgccagctgtcacaggaacgatggcctctttgtcagggcactgagtgcagttatctgtgcgcgttactctaactggcattcgaacgtcggcgacggggttaccggtggatcagactgttcctgtggcgtaaacgtttttatgttagtaccaacagatttaccacatttatcatcttaacagtttgagtgaaaatgcaggctgcgccgcaaagggaggagactgagtggcgtgttcagtctaaaagagagttgatgccagcatacaggggcgaagctggtcaacaagtcaacattaagataatggaatattcggagagaaacgtcaggcagttggcctcaaatgaacaggaagaatatatccccaggaaaattaatgttggtgttataaacacaccaacattaatccgatctgattattaatcagacaaatatcgttaatccgtcgaattttgaatcaacgttttttcttacgaccctgaacggccttaaaacgtggattagatttacaaatcacatacaaccgtccttttcgcttcacaatctgacagtctggatggcgttcttttgcggtacgcagagagttaagaactttcatcacgccccctttttcgtgctaacaaaacgaccaaaacgttgggtgaaccgtgcaacatttccttctgatgccactgttctcagcttccctgtatagaacgggtgcgatttcgaagagacatcaattgttacgtatggatacgttacgccatccagctcaatctcacggtctgttttgatagtcgagccgattttaaagtactcatcaatactggtgtcgtggaacaccacagtacgatactcaggatggatattgggcttcatcatttttacctgttatgttataacataaccataaagatacatgctcatccggatcatttcaacacccaatccctgtgcccatttttggtatgtggaatttccccaacggggaagtctggcattgttagcagccgttggcgacgctcccataaacgcctggatgagtgattgatgatggtttcgctgagagtatggatttttcgacaatggaggttatctccactttactggccgatgatttatcgcagtatgattgattacctgacagcgtgtattcctctcccacggatataataattacttacaaaaagggagaggatgcatattttaaatatcactgaagtgaacagtttattgccgttattaatagaaatggagaaataaataggcgtattctacaattgcgacaaaaacaacgatattaatcagtttatgactgatttgttgtactttattctctttcattggtacttcctcgctttaaaaaagagcgcacttcgtaagtgcccttatataaataacgagtttggtcaaccaattttttgacatgtatcacaaatttgaatggatgtattacatcggctatcttttattgcaccaacgtcattgatatatgtcgcctgaagtcagttccgggaatgagtttgatctcaagactggcccagtccgggcgttgattggcgctgaggagcatatcgcatctcatcataatgtcgtatctcctggggtgttatacaagatatcgttgttggtgacctgggagaggaattgagttctattaaaccgtcaactatgccggatacatactggattacactgcaggcacgccttacgagagaacgtgccgcagtgacgggttaattatctgaaagaatttgcgaggctgtatcggttactcattggtttgatagttttactctcgggagagtaatagatatttaattcattaacggaaaccagtcagttcctttcgatgcctgaatttgatcccatagtttatccggaatggttaattcatgaacaagttgtgttatcgttcatgagaagcataacgtaaagggaaaagctcgattagacggcaggatttgtcaggggttatgaacgaaattcataaatctgtttgagtgttgcgatgggtagtgcaagttcgatatctccgcaatttacagtctgatgaatgaaaatgaatatccataaaaaatatattggtttatcctggcgtatatacctacttcgatgtattgccaatcgtggtaaattaaagacaggtcattattattcactctgaataatgaattattcactgtccgcagagtaaaaaatataacttaggtgtctatttaatgacttgcacaaaaagctaaattttcacccataaataaaaatataatcccgcgcccaaccacctgatgagtggctacagacactggatatattaggtggcgatgcactttcttacataaaggtatttccttttctgcggaaaaggaaatcgggaaatccccggtttttctgacaagcagacgccattatttgtgtctgcctatgttcgttaattcgttcatcaggaaattatctcaatgtcgcgttataaaacagatcataaacaaccacgatttcgttattcagttctggcccgctgcgtggcgtgggcaaatatctctgttcaggttctttttccactcgctgtcacctttaccccagtaatggcggcacgtgcgcagcatgcggttcagccacggttgagcatgggaaatactacggtaactgctgataataacgtggagaaaaatgtcgcgtcgtttgccgcaaatgccgggacatttttaagcagtcagccagatagcgatgcgacacgtaactttattaccggaatggccacagctaaagctaaccaggaaatacaggagtggctcgggaaatatggtactgcgcgcgtcaaactgaatgtcgataaagatttctcgctgaaggattcttcgctggaaatgctttatccgatttatgatacgccaacaaatatgttgttcactcagggagcaatacatcgtaccgacgatcgtactcagtcaaatattggttttggctggcgtcatttttcaggaaatgactggatggcgggggtgaacacctttatcgaccatgatttatcccgtagtcatacccgcattggtgttggtgcggaatactggcgcgattatctgaaactgagcgccaatggttatattcgggcttctggctggaaaaaatcgccggatattgaggattatcaggaacgcccggcgaatggttgggatatccgcgcagagggctatttacctgcctggccgcagcttggcgcaagcctgatgtatgaacagtattatggcgatgaagtcgggctgtttggtaaagataagcgccagaaagacccgcatgctatttctgccgaggtgacctatacgccagtgcctcttctgacactgagcgccgggcataagcagggcaagagcggtgagaatgacactcgctttggcctggaagttaattatcggattggcgaacctctggagaaacaactcgatacagacagcattcgcgagcgtcgaatgctggcaggcagccgctatgacctggttgagcgtaataacaacatcgttcttgagtaccgcaaatctgaagtgatccgtattgctctgcctgagcgtattgaaggtaagggcggtcagacactttccctggggcttgtggtcagcaaagcaactcacggactgaaaaatgtgcagtgggaagcgccgtcattactggctgaaggtggcaaaattaccggtcagggtagtcagtggcaagtaacgctcccggcttatcgtccaggcaaagacaattattatgcgatttctgcggttgcctacgataacaaaggcaatgcctcaaaacgcgtgcagacagaggtggtcattaccggagcaggtatgagtgccgatcgcacggcgttaacgcttgacggtcagagccgtattcaaatgcttgctaacggtaatgagcaaagaccgctggtgctgtctctgcgcgacgccgagggccagccagtcacgggcatgaaagatcagatcaagactgaactaactttcaaaccggctggaaatattgtgactcgtaccctgaaggccactaaatcacaggcaaagccaacactgggtgagttcaccgaaactgaagccggggtgtatcagtctgtctttactaccggaacgcagtcaggtgaggcaacgattactgttagtgttgatggcatgagcaaaaccgtcactgcagaactgcgggccacgatgatggatgtggcaaactccaccctgagcgctaacgagccgtcaggtgacgtggttgctgatggtcagcaagcctacacgctgacgctgactgcggtggatactgatggtaacccggtgacgggagaggccagccgcttgcgatttgttccgcaagacactaatggtgtcaccattggtacaatttcggagataaaaccaggcgtttacagcgccacggtttcttcgacccgtgccggaaacgttgttgtgcgtgctttcagcgagcagtatcagctgggcacattacaacaaacgctgaagtttgttgccgggccgcttgatgcagcacattcgtccatcacactgaatcctgataaaccggtggttggcggtacagttacggcaatctggacggcaaaagatgctaatgacaaccctgtaactggtctcaatccggatgcaccgtcattatcgggcgcagctgctgctggttctacggcatcaggctggacggataatggcgacgggacctggactgcgcagatttctctcggcactacggcgggtgaattagaggttattccgaagctaaatggacaggatgcggcagcaaatgcggcaaaagtaaccgtggtggctgatgcgttatcttcaaaccagtcgaaagtctctgtcgcagaagatcacgtaaaagccggcgaaagcacaaccgtgacgcttattgcaaaagatgcacatggcaacgctatcagtggtctttccctgtcggcaagcctgacgggtgctgcgtctgaaggggcgactgtttctggttggaccgaaaaaggtgatggttcctatgtcgctacgctgacaacaggtggaaagacgggtgagcttctcgtcatgccgctattcaacggccagccagcagccaccgaagccgcgcagttgactgtcattgcgggggagatgtcatcagcgaactctacgcttgttgctgacaataaggctccgaccgtcaaaacgacgacgaaactcaccttcaccgtgaaggatgcgtacgggaaccttgtcaccgggctgaagccagatgcaccgcagtttagtggtgccgccagcacggggacagagcgaccttcaacaggagactggacagaaacaagtaatggggtctacgtggcgaccttgactctgggatctgccgcgggccagttgtctgtgatgccgcgagtgaacggccaaaatgccgttgctcagccactggtgctgaatgttgctggtgacgcatctaaggctgagattcgtgatatgacggtgaaggttgataaccagctggctaatggacaatcgactaaccaggtaaccctgaccgttgtggacacctatggtaacccgttgcagggacaaaatgtgacgctgactctgccgaaaggtgtgaccagcaagacggggaatacggtaacaaccgatgcggcaggtaaagccgacattgagctgatgtcaacggttgccggggaacacagcatcacggcctcagtgaataatgctcagaagacggttacggtgaaattcaaggcggatttcagtaccggtcaggcgagtctggaggttgatagcgccgcgccaaaagtagcaaacggcaaagatgcctttacgctgacggcgaccgttgaggataaaaatggtaaccctgttccagggagcctggtgacctttaatctgccccggggtgtcaagccgcttacaggcgataatgtctgggtgaaagccaacgatgaggggaaagcagagttgcaggtggtttcagtgactgccggaacgtatgagatcacggcatcggcggggaatagccagccttcggatacgcagactataacgtttgtagccgataaggctaccgcaaccgtctccggtattgaggtgattggcaactatgcgctggcggacggcaaagccaaacaaacgtataaagttacggtgactgatgccaataacaatttggtgaaagatagcgacgtgacgctgactgccagcccggcttcgttaaacctggaaccgaatggcactgcgacaacgaatgagcaagggcaggctattttcaccgctaccactactgttgcggcgacatacacactcaaggcgcaagtgagtcagaccaacggtcaggtatcaacgaaaactgccgaatctaaattcgttgcggatgataaaaacgcggtactcaccgcatcatctgatatgcaatctctggtggcggatgggaaatcgactgcgaagctggaggtgacactgatgtcggcaaacaaccccgttggcgggaatatgtgggtcgacattcagacgccggaaggggtgacggagaaggattatcagttcctgccgtcgaaaaatgaccatttcgtgagcggaaaaatcacgcgtaaatttagtaccagcaagcctggtgtctatacgttcacatttaacgccctgacctatggcgggtacgaaatgaagccagtgacggtgaccattaccgcggtggatgccgatacggcaaaggacgaggaggcgatgaaataattttaagaatatgaaagtaacattctaataaacaataatggcgttgacatcttcaacgccattatttattgaatttcctgacagtagtctcgttataaattcatttagatatagcgaaaactaaaccggacgaacggggataaaaatttcgcaaacaacatcattgctatccttttctacgaaatcttcattgtaataaaaccgctcaatatcactgccgttcactctggctaaccccctggcgggtaattccatcagatagaggtttcgcgcccattcagggtagtgctcccactcaccttcatagcggaaagaggcatacagtcctcggttaattgtccactctttcggcatctctgaatcggtttgtttgcataccgtaccggcaaaagtttcaaccgtgagcaaatcgaccgattttgttgacggttcaaacgtggagacgaaatagatatccgtcttaaaattattcatacatctggctaaatgatgacgtcgcagtttgacttcttcatccggtgatttattcgacacttcaatgtcatatttaaatgagttgccaaaaataggtgtctcaggaaaattgactaatctacactccgtcttttgctgttgacgtattaaaaaagaagggaagatatttgcgagatcccaataatcacggtggcggtattcacggggagagcagccgaataactttttaaattcgcggctgaatgactgctgtgaatcaaaatgcaaagagagtgcaatatcaagcatagatttcgcggtgagccggacaagaatagcggcacggcaaagccttcgtttgcgaatgtattctcccaaaggcacatgcatgaaatttcggaacagaagctggatgttgcgtctgctgtagccagatttctgtgcgatatcttcgattgaaatagggtgctcaagattgcactcaatccactccaggagctgctgtagaatcttctgcctgatcatcacattctccgttaattctttgtcatatcgcacattttcgttatgccctgggccctaagtgtatcaaaaacagcaagggcgaaggcaaaagcactggtagcgtctgcttcgttgtccccgaaaatagagaggtttcagtcctgcattattaatgatttttttgcataagtgatatcaaaatccacgtactaatttgaggttacgttttaacgtagactcattgttcatgcctaatggagggactgacagtggaattttccgtattaagtaacaatctgaaaatgccgatgatgggatttggtgtttttcaggttaccgataaaaacgtgtgcaaacagtcagtgttgaacgctatccgcacaggttatcgactcatcgacactgcagcggtatacggtaatgaagatgccgtcggtgaagccgttcgtgaagctatatctgaaggtttatgtacccgagatgagttatttataacgtctaaattgtgggtgcaggatatgttgaatcaggatacggcagcagcaggtattgaagcatcattaaaaaaatcgggactagagtacttcgacctctatttattgcaccaggctatgcgcgattatttcagtgcgtggcgtgcactcgaagatgcctatgaagagggcaaattaaaagcaattggggtttccaatttctatcctcatgttctggcgaacttttgtgaaacggtaagagttaaaccgatggtcaaccaggtcgagttgcatccctattttgcccaaccagaggcgctggcaaccatgaagtattataacgtgcagcctgaagcatgggctccgttaggtggtggacgacataaaccctttgaaaataatctgcttcagagtattgcagatgcccatcaaaaatcgatttctcaagtcattctgcgttggaatattcaacggggagtggtcgttattccgaaatcgacacatcaacagcgtatcgaagaaaattttgctatctgggatttctcactgacagagaaagaaatggcacaaattagttcgcttgatttgggttatgttggggagtcggtaaaacattttaatcctgaatttgttcgtggttgtcttgctgtaaaaatacatgattgatattaatcatatattttacctgagacgacaagaatcttttaacaggggagtgatattgatcttcactctgtcatatctccggtaatatggcgtcaggcttcatcatcagaaagggggcctgacgcctgaaaaagtgaacaacagacagtgttcggattatcaatattcagtttttaacgttgaactggattcattactgcgttgtttaagaatttcccgcgccgaatctgccattatcatgacagcacctgccagcatcagagtatctttcaataccaggcgaccagcaccggataaataagggaaaccatgatgagcgtcacccaatgcgggtacccatgcctccggggtggtgattaaaaatgagagtgttaccagcggcgtggtaaatgccatcagtcctcccaataaacctaaccagcgattgacaggattagccaaaaccagcagagcaataatcacctccacgacgccaagaccgttggaaaaaccataggtattattggccgtttgccatgcccttgcttctggtttgtattcgccttcgtgagtcagatactgtttatagtcttccgggtgttcataaaagaacgacattagtggactgtttgcgacgaatggtgtaatgctgtctgcctcgtaagggacaaactttaataacccaatccacataaaaacaattgcaatactcagacgaatcaatgtcaggccaattttatctccccgacttaacaggtgcaggtatttttccattgtgaacatccttatttatacaatactgctgttgcggttgaattattatcaattcgcatcgatgtgactttccaggatgaagcattatattttctggctatatcagcaatggtatcctccagaactgtcggtgatgctgatactgacgagacgctgatatgtttcagaattattttatcatctgcattggtggaaaatgccataacgccagataatagtgttgcaaataaaacagattttttaaacatataaaataccatcaatgaagtgattaagaagttatagagtaacagggaattaataagattcttttctctgagacgccagaatatttgttctggcgtctgattttgagtttatttgactaatgaaaatagatcattgagtgattcgctcatcgacggatgagtaaatatctgatcgcgtaatatgctataaggcagcccggcatccatcaccattttcactatattgatcatctcgtgggagtcaacacacagcagtgatgcccctaatatacgttgggttttattatcaacaatcgcttttaataccccacgagtatcattcatcactctggcacgcggaattgcagctacaggcaatgtcaccacctgaatatcagcaccactctctctggcctgttcttctgtcataccaaccctggacagtggcggtgtcatgaatacggaataaggcacatttttccgatcatcagtactacgtctgccttctcccagcaactcatcacgcacaatgcggtaatcatccagtgaaatataagtaaattgcagcccgccggtaacatctcccatcgcccaaatattgtctgcggtggtatgtaattgcttgtcaacgacaattgccccgcgctcgtttactgcgataccggcattttctggatgtaacgaagcggtagccggttgacgaccggaagctattaacagtgcatccaccgccagttgggcgtgctcgctatgcacttgcacttgattttcatggtgactgattcgctccacatgggcattgaggataatatcgacgccctgatcgcgtaaaatcgtcgcgatattatcagcaatatcccgatcttcccgaggcaaaaacagcgaagctgcttctaaaatggttaccttgctgccaaaattagcgaacatagaggcgaactcaacgccaatatatccgccgcccaaaatacctaaatgcccaggcaattcttttagattaagtaatccggtgctgtcatatacaccaggcgtggtggtaattccaggaattggcggaaccacggtttgtgcaccggtattaataaaaattttctcgccatgaatttccagatttccctcaggccgatgaacacgcaggctatgattattgataaactccgcctggccgtcgatcacgtcgatattgggcatatccgcaagattatgaaaattcttattacgtaaaaaattaaccacttcatttttacgctgtatggcacggacaaaatctgtgtgctgctgtgcgtcatgaaccaatgttttggttgggatgcagccgatattaatacaggtcccgccatacattgcatttgattgttcgatgagagccactcgccaacctgcttttgccagcgtgacggctaatgtttttccagccttgccaaaaccaataataactgcctgatatttattcatgatgatttcctgtcgaaacgcgttcatttgacatcatgactatagacgcaaaagagcaaataccatttcttcacaacgcttgatattttgtcttatcgtctggtattttctttttcttaatcagaatcacaaaacaaaaatcatgattaaccatttgatggtattagattagttatttactaagattgttggtgtttgtaatcaaaaaccactcaggagtctgatatggatgcccttagccgtttgttgatgcttaacgctccacaaggaacgatcgataagaattgcgtgttaggaagtgactggcagcttccacatggtgccggggaattatcggttattcgttggcatgcgttaacgcaaggagcggcgaagctggaaatgccgacgggagagatttttacattacgcccgggaaatgtggtcctgctaccacaaaattcagctcatcgcctgagtcatgtcgataatgaatcgacctgtattgtctgcggcactcttcggttgcaacattcggcgcgttattttttaacgtctttgccggaaacgctgtttttagcaccggttaaccacagcgtggaatataactggctgagggaggcgatcccgtttttacaacaggaatccagatcggcgatgccgggagtggatgcactgtgtagccagatctgcgctacattctttaccctcgcggtgcgtgagtggattgcacaggttaatacagagaaaaacattctcagtttgcttctgcatccacgtcttggtgcggtaatacagcaaatgctggaaatgccaggacacgcctggaccgtcgaatcgctggccagcatcgcccacatgtctcgggcaagttttgcccagcttttccgtgatgtttccggaaccacgccgctggctgtattaacaaagttgcgtctacaaatagcggcccagatgttttcccgggaaatgctccctgttgtggtgatcgctgagtcagtaggctatgccagtgaatcatcttttcacaaggcgtttgtccgcgagtttggttgtactccgggagaatatcgggaaagggtcagacagcttgcaccctgaataaaaccgccagaaatcagggcaaagataatccgcattccgggagttgtgagcctttcaactatttctatttccaacggtggtttgggctttatatatttttttctgatggactctagctcagtttttaaataaaaatgcaaactaaatttcttcaattaaataaagccccgactattacttgatacgtgattattgtcggtgatttttttgtacaccatcagtgtatatctcaataacccctgaataagtagctctgaataggtataagggatgtagcctttttaaatggatttcttatgccaaaaatgaacgtcgatttccccataaaatgtgagcgatgccgaaagaaataaaattagttattgcatttgaagtttggatgaaagattatcatttgtcatacaaatgaggggtggtatgttgctagccaattaaaaaagaacgccatatttattgatgattgatcccccggtgggggggaaacatcgggcataaatgggcatgaagtaatggagtattagttgtgaatgtcaatttctttgtcacctgtattggtgacgccctgaaatcaagaatggcacgagactccgtgctgctactggaaaaactcggctgtcgcgtaaatttcccggagaaacagggatgctgcggtcagcctgcgatcaatagtggttatatcaaagaagcgattccagggatgaaaaatctgatcgccgcactggaggataacgacgatcccattatttcaccggctggctcttgcacctatgccgtaaaaagttacccgacgtatctggcggatgaacctgaatgggcatcacgagccgaaaaggttgccgcgcgtatgcaggatctcacctcttttattgttaataaattaggggtagtcgatgtaggtgccagtttgcaagggagagcggtgtatcacccatcttgtagcctggcccgtaagctgggggtgaaggacgagccacttacgctgctgaaaaatgtgcgtggactggagctgttgacctttgctgaacaggatacctgctgcggatttggcggcacgttctcggtcaaaatggccgaaatatccggcgagatggtgaaagaaaaggttgtgcacctgatggaagtccgccctgagtatttaattggtgctgacgtgagttgcctgctgaacatcagtgggcgattacaacgggaagggcagaaagtcaaagtgatgcatattgctgaagtgttgatgagccgctgaggatataaagatgtcgatcaaaaccagtaatacagattttaagacacgcatccgtcagcaaattgaagatccgatcatgcgcaaagcggtggcaaacgcgcagcagcgtattggggcaaatcggcaaaaaatggtcgatgaattggggcactgggaggagtggcgcgatcgggccgcccagatacgtgatcatgttctgagtaatctcgacgcttatctgtaccagctctcagaaaaagtgacgcaaaacggcggtcacgtctggtttgcaaaaaccaaagaagacgctacccgctacattttacaggttgcccaacgcaaaaatgcccggaaggtggtgaaatctaaatcgatggtgaccgaagagattggtgtcaatcatgtgttgcaggatgctggcattcaggtgattgaaaccgatctgggtgaatatattctccagctggatcaagatccgccatctcatgttgtggtcccggcaattcataaagatcgccatcagatccgtcgagtgctacacgaacgtctgggctatgaggggccggaaacgcctgaagcgatgaccttattcatccggcaaaaaatccgcgaagatttcctcagtgctgaaataggtattaccggctgtaatttcgcggtggcagagacaggttcggtatgcctggtgaccaatgaaggtaatgcgcgaatgtgtaccacgctgcctaaaacgcatattgcagtgatgggaatggagcgtattgcccccacgtttgccgaggtagatgtattgatcaccatgctggcgcgcagtgccgttggtgcacgtttgacgggatacaacacctggctgacaggaccgcgcgaagcggggcacgttgatggtcctgaagagtttcatctggttattgtcgataacgggcgttctgaggtgctggcctctgaatttcgggatgtgctgcgctgtattcgctgcggggcttgtatgaatacttgtccggcatatcgccatattggcggtcatggatatggctctatttatccagggccaattggtgcggtgatttctccgctacttggcggctataaagattttaaagatttaccctacgcctgctctttatgcactgcttgtgacagcgtgtgtccggtgcgtattccgctgtcaaaactgattttgcgtcatcgtcgggtgatggctgaaaaagggatcaccgcaaaagcagagcaacgggcgataaaaatgttcgcttatgccaatagtcatccaggattgtggaaagtcgggatgatggccggtgctcatgcggcaagctggtttatcaatggcggcaaaacaccactcaaatttggcgcgattagcgactggatggaagcacgcgatcttcctgaagctgacggagagagtttccgtagttggtttaagaaacatcaggcgcaggagaaaaagaatggataatcggagcgaatttttgaataacgttgctcaggcactgggtcgcccgctgcgacttgaaccgcaagcagaagatgcgccgcttaacaactatgctaacgagcggcttacccaacttaaccaacagcagcgctgtgacgcgtttattcagtttgccagcgatgttatgttgacgcgctgtgagctgaccagcgaggcgaaggcggcagaagctgcaatacgtctgtgtaaagagctgggagatcagtcggtcatgattagcggtgacacgaggctggaggaattggggattagcgaacgtttgcagcaggaatgcaatgccgttgtttgggatccggcgaaaggtgccgagaatatctcgcaggcagagcaggctaaagtgggtgtcgtgtatgctgaatatggtttaaccgaatcgggaggcgtggttcttttttccgccgccgagcgcgggcgttcattgagcctgctcccggaatcttctctttttatcctgcgtaaaagcacaatcctgccgcgtgtagcgcaactcgcagaaaaattgcatcagaaagcgcaggccggtgaacgaatgccgtcctgcattaacatcattagcggccctagttcaacggcggatattgagcttatcaaagtcgtcggggttcatggcccggtgaaagcggtgtatctgattattgaggattgctgagagagatatgagatctgaacataaacctgaagaaggcatacgaggttgaaaatagcgttaaggacaacctgacttaaccccgttccgtcatggttatgctgctcttctgtaaatatcctggcattagtaatgccaggatatttacagtgaaaaagacaggcatccattcctgaaaacgggttcccttcccggtcattgtcacttcagctttatacaggcactctctatcagaatgttgtttattactgcccagagttttgttggtattcatctaccatttttttgacaaggcaaaacattacagaaattacaatgcttagaaaaaatcccagagccaggcaaatggcagcagggtatttattttttatttctggtgagcttatagttacacagccatcaccgttcggatacaatgaccagttcctggtcaggtatatcatttttgtataaagctcactgttaattgctgaaggcgtttgtatctcatcgagaacttgcctgccattatgatattctgacgcataccatttgataatagaggcctgcacgcgagatatttcctcttcagcagttggtaaagctctcttatctcctgaccattccagccttatttctctgttcttgacatctgggctggtctgaaaaaatgtagtaattcgctgaataacatcttcagtcattgtggtctgacaggcaaaattattattgctatcacagctaacaagtatacctggcgttgtctggtttatttttaggctgtaaatcacttttatattgtctttattgatatacagaaacaacagcaccatagccatacatatagccataataaaaaggataacacgaatctttttcttcagataaaataaaatctcaatcagatcgatatcctgtttgatttgttcacgcataatatatccagaaaataaaatctgccgcagataaggttgtattaatagtctgtatcaggaatgttcggggtaaatatcagcaaaaaaccagcatcatgaatactggatgtttatagcctgcagggggtataacagtcgacaggggaaccgactgctttattcttaccaggtcacattgataccaactacaccctgtagcgggttctcaatgtcgtcacctttggtgtagtcaaggcttgcatatgctcccatgtttttggtgatatcagcctgtacacctgcacccacgcggaatgctgcaccgtcaatgctggcattgacagactcatcacccagacggactttgttgccatcagagaattcgttcagtgcggccagattcagataaggtttaacggtcgagttgcccacagcgaagtcataacccacgcgcgtaccggcctcacccagcacagagttatagctgtcagaatgaacgtccacgccgttgagctgataatccacaccttccagcgtcagcgcagacagtttggcatatggctgaataaacaggccattaccgtctttccatgtgtaaccgcctttaaccatcgcaccgaaaccattggtgttaaagtcagctttgatggtaccgccaccattcatcaggcgaacatctgccgtgttgctgtagtgaccaaactgtgcagcagtatcaatgaagataccgttgttatactggcggctcaggtaagcgtggaagctgtaaccttcagtgtcgcctttgctctgcatggtggtcatgtcacctttcgcagaagacatcgctacacctgccagccagctaccatcttcagtcatgaagcgggtatcaccacccagcattacaccgtttacatccaggtcataggatgcatttcccgcggtggtatgtttctgtttaccgccaaagtactgaatccatacgccgcccttgtcattttcgctcagacggacagcatcctgacgggctgagagcgtgtcagcctgcagattagcaacgttagccggagctgctgccattgcctgaatcagggagctggcgttggatgctttatgcgtgttttttacgaaataaaagttaccatcagctccctgtgtcaggtcatattgatacagaccaccttccgttgtgcctgtggcttttagagtgctgtctttgccggtagaaataaatgccgtttgttcattgataagatccaatgaacccgcactgtaaacacgcaagtcaccgctcgcttttccgctgatatccagagtgttttcagaagaggcatcaacaatcagagtgccgttctgagaagcaaacgtgccagtattgactgtagccttcgtgatattaaccgtactgtcttttactgccagagcatcaacagttgaggatcccgtaacattccagacagacccgttttgcagagatacactggcatctcctgcccctgaaactttgcctttccagactgagctatcggaaagatttatatccagattactacccgctttatcgccgctattgaaggtataagcattaccttcccagtaagagcgggcaacgttcatgtttacatttgttgtggtaccggctgaattctcgcttgcagaaagggcatggatatcagagtagatggttgaatcggcgacagataaatttaaattttgcgttgctgaacctgctccttgtgccgaagcagaagcataaattgtttgtttattattagccgccccaattactgagccatccttaatattcagattgactgtatgagttcccgtattctccttggcaataactattgtttcaatccggccattaataatatttgagccagcaagggtaatgttgtcggttgcatcacctttaaaaccattcaatacgctacccttttgagcaaaaattgccgtagagccgttgctggaactcttattaccttgagcatttatggttgtaccatttagcgttacattatttcccgtggccccttccagagatattcctgtcgcactacttttttcattttttgcaacgaaattaccgccattaacaacaacatcgccagttgaagaaatgaccattgcagtccggacataggtgccttcaccttgagctgtgatggtggagcctgtagcattaatcacaacatttttgtcaccgctaacttttacaccttcaaggaattttttgtctgccgttgattcagcagtaatatcatgaccgccaaaagtaacattaagatctttatctgccgcattaattgttacggctgtaatctgttggtctgctgtattgctaataacaacatcttgatccagagttgtcttatctttatccagtgtaaccggtgtagttgataccgcgttatcagcagcgaatgctggtgcagaaagagccataacaatagctgtcgctaatgcgctgcggtaaaatgccttactgtttttcatgaagaaattctccattctggtaactaatttcaatttcccacttatttatatttatgcagagataaagcctgcgtccctgcatttaccaccacggaatacctgttggtatttccgttttcacgcaatgtcatggcattcgttttttccaatgcatttccatcaccgtgaaatttattgctgctcagcagcagggcttcccgcaatgacatgctgtccggtattccccaacgcttttttagcgactgctcagcaagccatatctgtcttatccccgttttgagaaactgcgcactgtattcccagctgtgtccagcaagaagcaacgacaacaccttcttttgcttttccgggaagcgttctgacatgacgattgtctttgtgcggttattcacctcattcataaagacagagtaactgtccataactggcaaattttctgcatgtttcagtcctgaaaacccaccagaggcatttgcaacactgatagcacgctctactgacattcctgttttcagtaacctcaggtttttgagaacgccagaaatactcacatccggtggcagaaaaaagggcgcgacgcacaacaccaccacgaatgagtgatcccgataaaatcggaaccacatttcagcgcattcggcaggtcgccctgccgatatcacgacactctgcggcctgtgccgcaatttattgcgtaactcttcttctgttctgatgcaggtaatattgcagacagaaccggttgatagagcttcaaactgtgcaggtacaattcctgagggacagaaaagaacgaaacgcatccttccctcacagatgtcagtacgccagcacgctgtacaggctgtacagcgtgcctcccactcctgcagcccagagcagtagaaatattttggcccctacactgtagcgagtccgtacgcgccgcagtgggtggtagtaacaacgctgctgtgtcataacactcctggtctttttttagacatatgttttctttgcccggaaagcacttttccggatatggcgtcagaatttattgatttaccaacgataactttctctggataaagaattccggacaccatgttctgcacatactgagtgagtcgatgagcggaatgttgtccgacatatcttgcatgtagccgtatattccgtttgactctgctgtcaccgcatcctgtatagagcagcctgaaatcgcttagtgttcccagtccaagtttccttaatgcctgtgtggcaatcgcatgcagagtctttgaactgcgttgttcataacgggcaatctcactgaaactcatgccctgcatcagaatcttaagcacgcttaactcccgtgcagtcaggagccagaaatcactcatatcgccgggtaaaggacgtagtaaccagcggataatttgattctgataacgactcgctttcagcaaggtgccgatatgtgggaagccgttatacagacttgaagcaggagcattatcgaaccagtcggagtcaccggtcaggcagacttgccattgcccggcatcactccgcaagcggacaagacaagccagaagaactaactcccccgaaggaagcgaagggatatcagccaacaggtagccacaggaggtctttaaaacgaattcaacctctgtagtgacgttgctgtacacccgcacgatatacctgtccgctgggatgagagactccagtgccagcctggtgaactgacaggcactgataataaccagaggcttcttcattcagactcgtccacgccattgctacaaaacctgacattttgattcaaaatgtcaggtttggtttaatagcctgaatatttaattttcttggaatataaatctaatttgtttgatttttattgtttttaattttgtgttatttaacaatatgagcgaaagttaatcactggtatgatctttgtggttaatcatttcaaatcatggggttattttactttagcgagaaatatcaacatgttatgtgttttatttaattgaatgggctgtttttttatggaagaattgaggaaaacgtaggaatctgacattttgaatcagaaggtactgttttaacgaggcttttttttccacacccctttaaaacgagcagcattactggctgtgtatctgacagtatgctgaatatttcgatgacccagataatcctgaagtagtcgggtatcgacaccattgtcagccagagcaaaaccacaggcatgacgtaacatatgaggatgtgcttttacagctaatcctgcacgttttccagcctcacgaatgatagaaaaaaaatgttgtctgctgatagggcggcgtttccgggagagaaaaagccagtctccttcaactccgttttcaattaacttcctctgcttaagccacaacttgatcaaattatattcatcaggaagaagaggatgtgttgtcgagaaaccatttttaatacgccgaatattaagttgttttccagatgcatcaatatcggataaacgtaaatcaagaagttcactggccctaaaaccgtgaatgaaagccatcataattagacagcgatttctttcaggaaaggacatactctgggctgcatccatcagcctgtaggtaatgactccaacttattgatagtgttttatgttcagataatgcccgatgactttgtcatgcagctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgctcaccgaatacgtgcgcaacaaccgtcttccggagactgtcatacgcgtaaaacagccagcgctggcgcgatttagccccgacatagccccactgttcgtccatttccgcgcagacgatgacgtcactgcccggctgtatgcgcgaggttaccgactgcggcctgagttttttaagtgacgtaaaatcgtgttgaggccaacgcccataatgcgggcagttgcccggcatccaacgccattcatggccatatcaatgattttctggtgcgtaccgggttgagaagcggtgtaagtgaactgcagttgccatgttttacggcagtgagagcagagatagcgctgatgtccggcggtgcttttgccgttacgcaccaccccgtcagtagctgaacaggagggacagctgatagaaacagaagccactggagcacctcaacaacaccatcatacactaaatcagtaagttggcagcatcacccagcctgtagacttcatcctgtgtgagatattttctcgtcatacgccaccgtgtacagttttaaaaaaaagagaggcacacccagataagtatgcctgcaatcagaacgttatcgatgtaatctcattatctcattattaagattttttgaatagtagttctacgcaacagattaaatatgaactatttattgtgcagcttttctacaagtcatttttaatgcgtgtttttatctacagtgatgtgagaaaataaatataaaagctatgaactacagggcgtgggggatgtgtgttacgtctaatcttttagtgatgtttagtagttttgagatatttgacgttatttcttatgaggttgtttttattatttatcttattgattttatatgcattttgtcgttctgtgaagttagggtgtagaaaataaaaatttaatattattcccgttaatttacaataacacattgttgtaagatattttttagtcgtaagtaaatcattattgatgggttctgctaataaattaaagatgttctcttaaatagttttttgctttttgtaaatatcaatttgtttatttttgattcatttgctggagagtatttcaacaatttttatttttcgcataaacttattaacaactttttattatcaattgaaaattaatgtaaaataaaatgttagcgaagcgataatcttgtgctaaaaaatatttaagcatgatgattaattaaagaagagtaaaaataaatcactgccaataaattatacgaatcgtgtttaaagctccacgttgttttggtctgacttatttttgtcctcgtttcaagaacccttttcgtatatgctaaccgtgagcgggagtgaacaagtcaccatagccaggaacactagcggcgtaattcttaagctgagtggcatttcacctgcggtttatcagtgcattcatagcaccttcatcagccagattgaacgagtccgcttagaatttgctggcgaggttgtcactatgaagcatgagagttacccctatgttttatataacgattctgtccccatacctggaacggtaactctcaatcagatcggttcttgagtcagttcaaatcacgactcattttttcgctctcaccggcatcccatttgccacaaaatatcccgccgtgctcctcggcagcgcttcctgtccacgaatcatatccgctattttctcgccaatcataattgtcgtggcgttcaaattcccggtgataatctgcggcataatcgacgcatccaccacacgcaggccttctaacccgtgtacgcggccttcgccgtcaaccacggacatctcgtcgtagcccattttgcaggtaccgcacggatggaaggcggtttcggcgtgattacgcacgaactcatcgagctgttcatccgtctgacattccgtgccggggctgatttcgcggccacgatactgatccagcgccggttgatgcatgatctcccgggtgatgcgaattgcgtcgcggaactcctgccagtcctgctcgtgcgacatgtagttaaacagaatcgccggatgctggtgcgggtcgcgggatttaatccgcacatgcccacggcttggcgagcgcattgagccgacgtggcactggaaaccgtgctctttcactgcattcgagccgttatagttaatcgctactggcaggaaatggtactgaatattcggccacgcaaattcctcacggctgcgaataaatccacctgcttcaaagtggttgctggcaccaacgccagtgccgccaaacagccactccgcaccgattttcggttggttccaccactgcagggcagggtagagggaaaccggttctttgcactcatattgcagatacatctccagatgatcctgaagattttcgccgacgccgggtaattcatgcaccagcggaatatcaaactccgccagcagttcagcgttgccgacgccggagcgttgcaggatctgcggtgaggcaatcgcgcctgcacataacagcacttctttgttggccgttgcgcgggttgggatggtgctgtcgccttccagccattcgacgcccaccgcgcgtttgccgtcaaaaatgatgtgatcggtcatagcgtgagtacgaatggtcaggttagggcgcgatttggcctgatcgagataaccgcgcgcggtactggcgcgacggccctgcggcgtgacggtgcgatccatcgggccaaaaccttcctgctgatagccgttgagatcgtccgtgcgcgggtagcctgcctgcacgcccgcttcaatcatcgcttcaaacagcggattgacgccgggtttggaggtggtgacgctcaccgggccatcgccaccgtggtagtcgttctcgcccacatcgcgagtctcggccttgcggtagtagggcaggcagtcgagataactccagttctccagaccgggttcttgcgcccagttatcgagatccagcgcattgccacggatgtagcacatgccgttgatcagcgacgatccacccaggcctttaccgcgtccgcactccatgcggcggttattcataaacggttcaggctctgtttcataggcccagttgtagcgtttgccctgtagtgggaacgccagcgctgcgggcatctgggtgcggaagtcaaagcgatagtccgggccgcccgcttcaagcagcagcacggaggtattcggatcttcagtcagacgggtagcgagaacgttgccggctgagccggcaccaataatgatgtagtcaaattgcaaataaacctcctggttagaatatggactggaatttagccatctcaacctggatggacttcacctgggtgtaactctggagcgtcatcacgccgttctcgcgaccaatgccggagtgtttgtagccgccaacgggcatctctgccggggattcaccccaggtattgatccagcaaatacccgcttccagctgatgaatgacgcgatgcgcgcggttcaggtccgccgtcacgatacccgccgccagaccatagtcggtatcattggcgcggcgaatgacttcgtcttccgtctcgtaggtcagaatggacatcaccggcccgaagatctcttcacgcacaatggtcatatcgtcgcggcaatcggtgaacacggtcggtgccacccatgcgccgttatcgaagccatcgcctttcagtacatcgccgccgcacagtacgcgcgcgccttcctcttggcctttggcgatatagcgcagcacgttatcgcgatgcgggaagctgaccagcgggccgaaattggtttgcggatcgaaaacgtcgcccgcgcgaatgcgctcaacgcgcgccagaatcttttgttcaaatgcggctttgcatttcgccggaacgaagacgcgggtgccattggtacacacctgaccggagctgaagaagttcgccatcatggcgatatcggcggcgagatcgagatccgcatcatcgaaaacgatcagcggtgatttaccgcccagttccatggtcacttctttcagggaagaggccgccgagttagccatcacttttttgccgctggcgacaccgccggtaaatgacactttggcaatgcccggatgctcggtcagatattgcccggtctccgcgcccacccccggcaacacgttaaatacgccgtccggcaggcccgcttcgctgtaaatttcagccagctttaacgcggtaagcggggtgacttcgctcggtttgaaaatcattgcgttgcctgccgccagcgccggggcggatttccacagggcaatctgaatcgggtagttccatgcgccaatccccgccaccacacccagcggttcgcggcgggtataaacaaatgacgtctcacgcaacgggatctggctgccttccagcgccgggatcagcccggcgtagtactccagcacgtccgcaccggtaacgatatcgacggttgaggtttccgaatatgcttttccggtatcgagggtttccagttttgcgagttcgtcattgcgttcacgcagaatatcaacggcccgacgcagaatacgcgagcgctccatagcggtcatcgccgcccagattttttgcccctgttgggcactcttcacggcgcgatcgacatcctcacgcccggcggcctgcacggtcgccagcacgttaccgttggccgggttaatggtctcgaaggtgcgaccgctggtggcggaggtataaccaccatgtatataaagctgctgttctgccattcgggacatcacgtctcctcggttaatcggtgggtaaatgctgagtaataaagtgacgggtcagcgagtgtgcgagaggtttatccagcggtttgccgctcagtgccgcgcgcagccataatccgtcaatcagcgcggcaaggccgtagcccgcttcctgtgcctgttggcgcggtaactcgcggcgaaattcgctcaccagattcgacaataagcggcggctactgacctgctgtaaacgatagagcatcggctgatgcatactgctggcccagaacgccagccaggctttcatcgccgcactgctcacctgcgtttcatcgaagtttccgccaacaatcgcctgtaatcgctgctctgcactgccctgcggaagtgcatgtaatcgattcaaaaccgcgtcacgcagctgactggtgatatcgcgcatggttgcttccagcagaccatttttgtccctgaaatagtggctgatgatccccgtagaaacgcctgcacggcgggcgatctgcgcgatcgttgcatcgtgcatgcccacttcatttattgcttccagtgtggcgtcgatcagttgtctgcgccggatcgactgcatccccaatttgggcattttcgccactccattcatcagcgttgtttatctattaaagcggttattgattggacgttcaatataaaatgtgtcttaattgttacgaatttgattttaaatggtaacaataacagtggggatactggatgacagacctttcacacagcagggaaaaggacaaaatcaatccggtggtgttttacacctccgccggactgattttgttgttttccctgacaacgatcctgtttcgcgacttctcggccctgtggattggccgcacgctggactgggtttctaaaaccttcggttggtactatctactggcggcaacgctctatattgtctttgtggtctgtatcgcttgttcgcgttttggttcggtgaagctcgggccagaacaatccaaaccggaattcagcctgctgagttgggcggcgatgctgtttgctgccgggatcggtatcgacctgatgttcttctccgtagccgaaccggtaacgcagtatatgcagccgccggaaggcgcgggacagacgattgaggccgcgcgtcaggcgatggtctggacgctgtttcactacggcttaaccggctggtcgatgtatgcgctgatgggcatggcgctcggatactttagctatcgttataatttgccgctcaccatccgctcggcgctgtacccgatcttcggtaaacggattaacgggccgatagggcactcagtggatattgcagcggtgatcggcaccatcttcggtattgccactacgctcggtatcggtgtggtgcagcttaactatggcttgagcgtactgtttgatattcccgattcgatggcggcaaaagcggcactgatcgccttgtcggtgataatcgccacgatctctgtcacctccggtgtcgataaggggattcgtgtgttatcggaacttaacgttgcgctggcgctgggattgatcctgttcgtattgtttatgggcgacacctcgttcctgcttaatgcgctggtgctgaatgttggcgactatgtgaatcgctttatgggcatgacgctcaacagttttgccttcgaccgtccagttgagtggatgaataactggacgctcttcttctgggcatggtgggtggcatggtcgccgtttgtcggcttgttcctggcgcgtatctcgcgtgggcgtaccattcgccagttcgtgctgggcacgttgattattccgtttaccttcacgctgttatggctctcggtgttcggcaatagcgcgctgtatgaaatcatccacggcggcgcggcatttgccgaggaagcgatggtccatccggagcgcggcttctacagcctgctggcgcagtatccggcgtttacctttagcgcctccgtcgccaccattactggcctgctgttttatgtgacctcggcggactccggtgcgctggtgctggggaatttcacctcgcagcttaaagatatcaacagcgacgcccccggctggctgcgcgtcttctggtcggtggcgattggcctgctgacgctcggcatgctgatgaccaacgggatatccgcgctgcaaaacaccacggtgattatggggctgccgttcagctttgtgatcttcttcgtgatggcggggttgtataaatctctgaaggtagaagattaccgccgtgaaagtgccaaccgcgataccgcaccgcgaccgctggggcttcaggatcgcctgagctggaaaaaacgtctctcgcgcctgatgaattatccgggcacgcgttacactaaacagatgatggagacggtctgttacccggcaatggaagaagtggcgcaggagctgcggttgcgcggcgcatacgtggagctaaaaagcctgccgccggaagagggacaacagttggggcatctggatttgttggtgcatatgggcgaagaacaaaactttgtctatcagatttggccgcagcaatattcggtgccgggctttacctaccgcgcacgtagcggtaaatcgacctactaccggctggaaaccttcctgttagaaggcagccagggcaacgacctgatggactacagcaaagagcaggtgatcaccgatattcttgaccagtacgagcggcaccttaactttattcatctccatcgtgaagcgccgggccatagcgtgatgttcccggacgcgtgattgtttttgcataaaaccgcgccatgtctgcatatggcgcgggaatcattgactcgctgtaaaaaattatgcatatattatatatgattgtcatgtcatatcctgcaattcctcttgtatcacttcatgattttatattttattaattaacgattttattttgtattagctgaatggattcagtcctatagtgttatatatttattaataagacgattcttatattttgatacctaataagagttaccgcttttatcggctgtatattaaatgtattcctcttgcttttgtttatattttgagttgatttgagttcctggatacatataatgcgcaggtattagagactgggaggaatgtaatgataaagttaagagtgttaacttaaaataagttttaagtaataacttgctattttattaccctctgaactacatactcagatatgtggttgccaatgctatgcaaaatttttgaatttttatatgcgatgaacagtaaccagaatggcatttaatgcgttgctgtttatgcaatcttggttttatttggatgtattgctggagattgtgatgaataaaatatatcggctaaagtggaacaggtcccgtaactgttggagcgtctgctctgagctggggagcagagtaaaaggaaaaaagtcccgggctgttttaattagcgcgataagtttatattcatctctggtattcgccgatgatgtcatcgtaaaccaggataaaactattgattttggcaaagagaaccagagcatcgattaccgtattacggtgactgacaatgccaatctggtaatcaatacgacagatacttcccgtccgcgtctgactctcgcttctggtggtgggttggatattaccggaggaaaggtaacaatcaatggcccgcttaactttttgctgaaaggtacggggttcctgaatgtctccaatgctggcagcgagttatatgctgatgatttgtatgagtcaaactcaggcatgagacatgatcaaggctattttaatgtctccaatggcggcaaaattcatgttaagggcaccagtcgtctgacttatacgcaggggaatgtaagcggcgaaggtagtcaggtaaatgcagggaccttctttatgggcgtttacggcggatatggcggtaatcagttcctgtcggttaataacggtggtgaagttaatgctcgtgaacatattagcctgggttattacgaccaacgttctgatacaacattagtcgtatcagatggaggtaaaatatccgcaccgaaaattagtttaagcaccaactctgagttagcgttaggtgcacaggaaggaagtgctgcgaaggctgcagggattattgatgccgaaaaaattgagtttgtgtgggcaaagacatccgataagaaaatcaccttaaaccacacggataaaaacgcgactatttccgcggatattgtcagtggcagcgagggcctgggctatatcaatgcgctcaatggcacgacttacttaaccggtgataactctgcctttagtggtaaagtcaaaattgagcaaaatggcgctttagggatcacccaaaatataggtacagcagagatcaacaaccgcgggaaattacacctgaaggctgacgatagcatgacctttgccaataagatttccggcaatggtacaataagtatcgacagtgggacagtggcactgaccggcaataactatgcattcagcggatatattgatgtcgcttctggtgctgtcgcggttatttctgaagacaagaacatcggccgtgcggacctggatgttgatggcaaactgcaaatcaatgccaataaagattgggtatttgataacgatcttcaaggtagaggtattgttgaaataaacatggggaatcacgaattctccttcgatgagtttgcttatacagactggttccagggttcactggcgttccagaacacgacatttaacctggaaaagaatgctgagtttctgcagagaggcgggatcactgcgggtcagggaagccaggtaacagtgggtaagggcgctcactccattagcactttgggattctccggcggaaccgttgattttggtgccctgacagcaggtgcacagatgacagaagggacggtcaacgttagtaaaacgctggatttgcgcggcgagggtgtgattcaggtttctgacagtgacgttgtaagctcagtatctcgtgatattgactctgcgttatcgctcactgaagtcgatgatggtaacagcaccattaagttggttgatgcgcaaggtgcggaagttctgggcgatgcgggcaatctgcaattgcaggataaaaatgggcaaatcctctccagcagtgcccaacgtgatattcagcagaatgggcaaaaagcggccgtcggcacttacgactatcgtctgacgagtggggtaaacaatgacggtctgtatatcggttacggcctgacccagcttgatttacacgctaccgacagcgatgctctggtgctgagctctaacggtaaaagcgagaatgccgccgatctcagcgcaaagattaccggcagtggtgacctggcattcagcagccagaagggtcagaccgtatcgctttctaacaaagacaacgactataccggtgttaccgatctgcgcagtgggacgcttttgttgaataacgataacgtgttgggtaatacccatgaactgcgtctggcggcagagactgaactggatatgaatggtcacagccagaccgtgggcacgctcaatggcagcgccgattcactgctgagcttaaatggcggcagtctgacggttaccaacgggggcacttcaaccggttcgttaacggggagcggagagctgaatattcagggcggcacgctggacatcgcgggcgataacagcaacctgacggcgaatgtgaacattgctaattcggctaatgtcctggtaagtcatgcgcagggattgggtagcgcaaacgttgagaacaacggtaccctggcgttgaataatagcgctgaaaaaagagcggctgcgtctgtgaattacaccctgggcggcaatctgaccaacaacggtacgctgatgaccggaatgtcaggacagcaagctggcaatgtgttagtggtgaaggggaactaccacggtaataacggtcaactagtaatgaatacggtactgaatggcgatgactcagtaaccgataaattggttgtcgagggcgatactagcggcacgactgccgttacggtgaataacgctggcggtacaggtgcgaaaacccttaacggtatcgaacttatccatgtagacggtaagtctgagggcgaatttgttcaggctggtcgtatcgttgcgggggcgtatgactacactctcgcgcgtggacaaggggcaaatagtggtaactggtatctgaccagcggcagtgattctcctgaactgcagccggagccagacccgatgccgaatccggagccaaacccgaatccagagccgaaccctaacccgacacctacgccgggtccggatctgaatgtggataatgacctgcgaccggaggcgggtagctacattgcgaaccttgcagcagcgaatacaatgttcaccacgcgtctgcatgagcgtctgggtaatacgtactataccgacatggtgacgggtgagcagaaacaaaccactatgtggatgcgccatgaaggtggtcatagtaaatggcgtgatggcagcggccagctgaaaacccaaagcaatcgctatgttctgcaactgggaggcgatgtcgcgcagtggagccaaaacggcagcgacagctggcatgttggggtcatggcgggatatggcaacagcgacagcaaaaccatttcctcgcgaaccggttatcgtgcaaaagcgagtgtgaacggatatagcaccggcctctatgccacctggtatgccgatgacgagtcgcgtaatggcgcgtatctcgacagttgggcgcagtacagctggtttgataacacagtgaaaggggatgacttacaaagtgaatcctataaatcaaaaggatttaccgcttcactggaagctggatacaaacacaaattagctgaatttaatggcagccagggaacgcgtaatgaatggtatgttcagccgcaagcacaggttacctggatgggagtcaaagccgataagcaccgcgaaagcaacggaaccctcgttcatagcaacggtgatggcaatgttcaaacccgacttggcgtaaaaacctggctgaagagccaccataaaatggatgacggtaaatcccgcgagttccagccgtttgtagaagtgaactggctgcataacagtaaggatttcagcaccagtatggatggcgtgtccgtcactcaggatggagcccgaaatattgctgagataaaaaccggggtggaaggacagctaaatgccaacctgaatgtctgggggaatgtgggcgttcaggttgccgataggggatataatgacacctctgcaatggttggcattaagtggcaattctgatctgaataatgagtaaaaggagagagagccgaacgggagataattcggctctctgtgtcattttcttgcagccagctttatcagtcagagtgaagactcgcagatttagctggcgcacaagatttaatcaaggtgtgttcaatggcttcgcatgatttgagtgtttttttggaagagttcggggcaacggtgaatttgacgttgcctggtatcgtgtccgaaaaagaacggcttttactcaagctgctaatggagggaatgtcggttacagaaatctcacagtacagaaatcgcagtgcaaagacaatttcacatcaaaagaagcagctgtatgaaaaactaggcatccagagtgatattaccttctggcgggatatcttttttcaatatcatccgcaagtcatcagtggcacgggaaataaaaataatttttatatccctgataaccgttgtcaccatatcgtcacgcctgaagccatcagtctggcgttggaaaaccacgaattcaaaccgtggatccaaccggttttctgcgcgcagactggggtactgacgggctgtgaggtacttgtccgctgggaacatccacaaacgggaattatcccaccggatcagtttattcctctggcggagtcatccggtcttattgtcataatgacccgccaactgatgaaacagactgcggatattctgatgccggtaaaacatttgctgccggacaatttccatattggcatcaacgtctcggcgggttgttttttggcagcgggatttgaaaaagagtgtctgaacctggttaagaaattaggtaacgataaaatcaagctggttctcgagctaacggaacgtaatcctattccggtaacgccagaagccagagcgatatttgacagccttcatcagcacaacattacctttgcgctggatgactttggtacgggttatgcgacctatcgttacttgcaggcgttcccggtcgattttattaagatcgataagtcatttgtgcaaatggcgagtgtcgacgaaatctccggtcatattgtggacaatattgtcgaactagcgcgtaagcctggtctgagtatcgtggcggaaggggtagaaacccaggagcaggcggatttaatgatcggtaaaggcgttcactttttgcagggctatttgtactctccgccagtaccgggtaataaatttatctctgaatgggtaatgaaagcaggtggttgatgtaaaccgctattcacagcgcatcgggaggttggcagcgattaattctcccgatgcagtaaatcctgatagatccccgttaatatgccatttggcgcaaattgttttttaatccactgcgtcacctgacccgtagcagaatgctgagtcgccagtaacatgcgcgaatcctggcgcggattatggatttgtcgggtaaccagcagggattgcgtcatcgcctcacggaccatgtaatccggcaaaaaaccaattccttcacctaaaatctggcactgacatttggtgttgaaatctggcaccagaattgactcctgcccgtgcagcaaccagcccacttttttattaatcgtatgcgcggtgtcctccaccataatattagggtagagacgcagttggctttcggcgatgggttccggcacaaaggctaacgggtgatccggggcgatagcaaaagcccagcgaatcgcgccaatttcagtgtaatcaataccgccgccgtccagtagtgtatcgggtgcgccgatggcgatattggcctgattattaataatcgcatcccagacgccgttatacacttcggtggtgacggtaatctggcaggtaggaaactgctttttcagcacctgtaacaagcgtgcggtgtgtttgggcgtataaagcagctgattaatacaaatgcgcacacgcgcttctatgccctgcgaaatagtatcgatactgcgtttgatggcataaaaatcattcagcaggtcggtagctttgcggaaaaaataacgcccggactccgttaactcaatgctgcgggtactgcgagtgaacagcaccacatccagccccgtctccatacgcttgatggtgtagctaatggcggaagtggttaaacccaactcttctgcggctttactgaagctgccaaaacgtgcagcggtagtaaatgccaacagattctcttcggtaaaaattgagttcattaaaccattctcgccattatctactatgaatttctccagctatgactgtagaggtatcggttaaagatagataatcatttttgaataacttttaatacccgtcgcgtttagtcgtcgcttcgcttaatttttgtccaccatattctgaaattatccccacgcagttacccgccagaaaacccagtaacgtcaccgtccagttcatcccgctggcaaaaaacagcgtcatgccgagaaagccaccgggaataaaggacagtaaccagaaacgcccttgccagaccactaccgccgagaagggtacggtagtaattacgctcgcccagaacgcggacagtccacttacagaggccagccaaccagcagtcagcgcggcgaaaaacgcccacaccatcccggaataattaaccgccagacttctgataaaccccgagttaccgccgcctgcggcataaaaactgcaaaaggcgacgaagccaatggttcctaataattcccatccttgagagagcccgacatgtgaagacactaactgccaaagccctgcacaaataccgacggtgacacccgttgccgtgagtccgttcatcttgttcccctctggttagacatggacgaaagctactcttacatgtgcagactatagagaaataaaatctgattgagtgaaagggtatcgggtcaaagaaacaaatattgcactaccgcacactgcgaaaagattgttgaatattattcaacaaaaaggcgagatacggcgaattaaatttaagcgggttcttttatcagattatcgttgctattctcaattcatcgaaaacagccacaaaaaccaggggaatgtgaatgagtataaaaaatctacctgccgactatttattggctgcacaacagggtgatatcgataaagtaaaaacctgccttgcgctgggtgtcgatattaatacctgcgatcgtcaggggaaaacggcaattacgctggcaagtttatatcagcaatatgcttgcgttcaggcattaattgatgccggagcggatattaataagcaagatcatacctgtttaaatccttttttaattagctgtctgaacgataatttaacgctactacgaattattttaccggctaaacccgatcttaattgcgtaacccgttttggcggtgtcggcctgacgcctgcctgtgaaaaaggccatttaagtattgtaaaagagcttttggcgcatacggagattaacgttaaccagaccaaccatgtaggctggacgccgctactggaagcgattgtgcttaatgatggtggtattaaacagcaggcgattgtgcagttattgctggaacacggtgccagcccgcatctgaccgataaatatggcaaaacgccactggaactggcgcgggaacggggctttgaagagattgcgcagttactgattgccgcaggtgcataaaccgggaggcttgctatcaacacaccagaaagacggtgtgtgtgggcgctaactgcggatgcggattttctggcgcagcgggggcaaggacaggttgaacaggtctttgccagagcggtaaatatcgcactcccggctcgccagcagttgctgacgctgctttgtgaagagtacgacaatgcgccaaacagttgtcggttggcactcactcactttgatgatctgttccggcatggtgataaggttcagtttgacgatcaaggtattacggttggtcaacatcttcatatagagatgagtcgttgtcggcgttggctgtccccaaccttgcaaatgaccgctgtgaattttcaccttatcgcctggctacagtggcacgacattattcatcagcacctgggggaaaatgaaaccctgtttaattatcgcggcgataatccgttttatcaggcgttaaataaagaactacatattaaacgacgggcagttattcaggcagtaaacgaaaaacaaaatatcgccgcagcggtcgccagtatgattgggttagggattggccttacgccatcagccgacgattatttaacaggtctggcgcttattttatttattcccgggcatccgtcggaaaaatacaaagaggaattttatctcggtatgcagcgcggcagaaataacaccacattattaagtgctataacgctggaagccgcattacaacaacgttgccgggaaaatattcatcgttttattcacaacattatttatgacatccctgggaacgcaactcaggcaatagaaaaaattaaacatattggctccagttccggctgcgacatgctgtatggcatggccgatggttgtgcgctgagccaaacctacggagggaattatgtcagttaaaatagtcattaaaccgaatacctattttgattctgtctcgctgatgtctatctccacgcgtgcaaataaactcgacggcgtcgagcaggcatttgtggcgatggcgaccgaaatgaacaaaggtgtactgaaaaatttaggactgctgacgccggagctggaacaggcgaaaaacggcgacctgatgattgtcatcaatggtaaatcgggtgcggacaacgagcagttgctggtggagattgaagaactgttcaacaccaaagcgcaaagcggctcgcacgaggcgcgttacgccactattgccagcgccaaaaagcatatcccggaaagtaacctggcggtgatttcggttaacggtctgtttgccgctcgcgaagcgcgtcaggcgctgcaaaacgatctcaacgtgatgctgttttccgataacgtctcagttgaagatgaactggcgctcaagcagttggcccacgaaaaagggctgctgatgatggggccggactgcggcacggcgattattaacggcgcggcgctctgttttggtaacgccgtgcgtcgcggcaatatcggtattgttggcgcatccggcaccggcagccaggagctgagcgtccgcattcatgaatttggtggcggtgtttcacaactgattggcaccggcgggcgcgacctgagcgagaaaatcggcggcctgatgatgctcgacgccatcgggatgctggaaaacgatccgcaaactgaaattatcgcactgatttcaaaacctcccgcgcctgcggtggcccgcaaagtgctggaacgcgcacgtgcctgccgcaagccggtggtggtctgcttcctcggtcgcgttgaaacgccggtggatgagcaggggctacagtttgcccgcggcagcaaagaggcggcgctaaaagcggtgatgctctccggcgtgaaacaggaaaatctcgacctgcatacgcttaaccagccgttgattgctgatgtgcgtgcgcgtctgcaaccgcagcagaaatacatacgtggcctgttctgcggcggcacgctgtgcgacgaaaccatgttcgcggtgatggaaaaacatggcgatgtctacagcaacattcagcccgatcctgaattccgcctgcaagatatcaaccgcagcatcaaacacaccttcctcgactttggcgatgacgacttcaccaacggcaagccgcatccaatgattgaccccaccaaccgcatcagtcgcttgatcgaagaagcgcgcgatccagaagtggcggtgatcgtgatggattttgtgctcggatttggatcgcatgaagatccggtcggctccaccatcgaggcgatcaaagaagcgaaagcgatcgccgccgccgaaggacgcgagttgatcattctcgcctatgtgctgggcaccgatctcgatacgccatcattagaacaacaaagccagatgctgcttgatgccggagtgattctggcgagcagcagcaccaataccggattgctggcgcgtgaatttatctgcaaaggggaggaagcctgatgagccagtcactgtttagccaaccgttgaacgttattaacgtcggtatcgccatgtttagcgatgacctgaaaaagcagcatgtagaagtgactcaactcgactggacgccgccggggcagggcaatatgcaggtggtgcaggcgctggataacattgccgattcgccgctggcagacaaaatcgccgccgctaaccagcaggcgctggagcgcattatccagtcgcatccggtgctgattggttttgatcaggcgattaacgtggtgccgggcatgacgccgaaaaccattcttcacgccgggccgccgatcacctgggaaaaaatgtgcggcgcgatgaaaggcgcggtcaccggggcgttggtgttcgaagggctggcgaaagatctcgatgaggcgactgaactggcggcctccggggagatcaccttctcgccgtgccacgaacacgactgcgtgggatcgatggcgggcgttacctcggcctcgatgtttatgcacatcgtgaaaaacaaaacctacggcaacatcgcttataccaatatgagcgagcagatggcgaagattttgcgtatgggtgccaacgatcagagcgtgatcgaccgcctcaactggatgcgcgatgtgcaggggccaatgctgcgcgacgcgatgaaaattatcggtgagatcgatctgcgcttaatgctggcgcaggcgctgcatatgggcgatgagtgccataaccgcaataacgccgggacgacgctgctgattcaggcactgacgccggggatcattcaggcaggctattccgtcgagcaacagcgcgaagtgttcgagtttgtcgccagcagcgactacttctccggcccgacgtggatggcgatgtgtaaagcggcgatggatgcggcgcacggcatcgaatacagcaccgtggtcaccaccatggcgcgtaacggcgtcgagttcggcctgcgggtcagcggcctgccggggcagtggtttaccggcccagcgcagcaggtcatcggcccgatgtttgctggttataagccggaagattcggggctggatatcggcgacagcgccatcacagaaacctacggtattggcgggtttgccatggcgaccgcgcctgcaatcgtcgcactggtgggcggcacggtggaagaggctatcgatttctcccgtcagatgcgcgaaatcacccttggcgaaaaccccaacgtcaccattccgctgctcggttttatgggcgtgccgtcggcaatcgacatcacccgcgtgggtagcagcggcattctgccggtgatcaacaccgccatcgcccataaagatgcgggcgtcggcatgattggcgcgggcattgtgcatccaccattcgcctgcttcgagaaagccattctcggctggtgcgaacgttacggcgtctgacttacatgtttatgccggatgcggtgtgaacgccttatccggcctacggatggcccgagaattgtaggcctgataagcgtagcgcatcaggcagtctggcgttggtcataacctaatcaccctctgtagcggacataacaacatgaaagagcttgtggtcgttgccattggtggcaacagcattatcaaagataacgccagccagtcgattgagcatcaggcggaggcggtgaaagccgtggccgatacggtgctggaaatgctggcttccgattacgacattgtgctgacccacggtaacgggccgcaggtcgggctggatttacgccgtgcggagattgcccacgagcgcgaagggctgcccttaacgccgctggcgaactgtgtggcagatacgcagggcggcatcggctatctgatccaacaggcgctgaataaccggctggcgcgtcacggcgagaaaaaagccgtcaccgtgataactcaggtggaagtggataaaaacgatccaggttttgcccatcccaccaagcccattggtgcattcttcagtgaaagccagcgtgacaaactacaaaaggcaaaccctgactggtgttttgttgaagatgccggacggggctatcgccgcgtggtcgcctcgccggaaccgaaacgtattgtcgaagcacccgccattaaggcgctgatccaaaaaggttttgtcgtaattggcgcgggcggcggtggaattccggtagtgcgtactgaagcgggggattaccaaagcgtggacgcggttattgacaaagatctctctaccgcgctgctggcccgtgaaattcacgccgacattctggtgatcaccaccggcgtcgaaaaagtctgtatccactttggtaaaccgcagcagcaggcgctggatcgggtggatattgccaccatgactcgctatatgcaggaagggcattttccgcccggcagcatgttgccaaaaatcatcgccagcctgacgttcctggagcagggtggcaaagaagtgattatcaccacgccggaatgcctgcctgcggcgctgcgcggtgaaacgggcacccatattattaaaacgtaaggacgtaggatgaaagaaagcaatagccgccgtgaatttctgagccagagcggtaagatggtcaccgccgccgcgctgtttggtacctctgtgccgctcgcccatgcggcggtagctggcaccctaaactgcgaagcgaacaacaccatgaaaatcactgacccgcattactatctcgataacgtgctgctggaaaccggttttgactacgaaaacggtgtggcggtgcagacccgcacggcgcgccagaccgtggagattcaggacggcaaaattgtcgccctgcgcgagaacaagcagcatccggacgccacgctgccgcactatgacgctggcggtaagttgatgctacccaccactcgcgacatgcatattcatctcgacaaaaccttctacggcgggccgtggcgctcgctcaatcgtccggcaggcaccactatccaggacatgatcaaactcgagcagaaaatgctgccggagttacaaccgtatacgcaggagcgggcggaaaaactgatcgatctattgcagtcgaaaggcaccaccattgcccgcagccactgcaatatcgaaccggtttccggcctgaaaaatctgcagaatttgcaggcggtgctggcgcgacgtcaggcgggcttcgagtgtgaaatcgtcgccttcccgcagcacggtttgctgctgtcgaaatcggaacccttaatgcgcgaagcgatgcaggcgggtgcgcattacgtcggcgggctggacccgaccagtgttgatggcgcgatggaaaaatccctcgacaccatgtttcagattgcgctggactacgacaaaggtgtcgatattcacctgcacgaaaccactccgtcgggcgtggcagccatcaattatatggttgaaacggtagagaaaacgccgcaactgaaaggtaagctgaccatcagccacgcctttgcgctggctacgctcaacgaacaacaggtcgatgcgctggcgaatcggatggcggcgcagcaaatttctatcgcctcgacggtgccgattggcacgctgcatatgccgctcaaacagttgcacgacaaaggcgtaaaagtgatgactggcactgacagcgttatcgaccactggtcgccttatggtctgggcgacatgctggaaaaagccaatctctacgcgcagctctatattcgtcctaacgaacagaacctctcccgttcgctgtttctagccactggcgatgtattgccgctgaatgaaaaaggcgagcgtgtatggccaaaagcgcaggatgatgccagctttgtgctggtggacgcctcctgttccgccgaggcggtggcgcgtatctcgccgagaaccgcaacgttccataaagggcaactggtgtgggggagtgtggcaggttgatgcgcatttgaaacgcctgcaacggtgaattgtaagagatttaagcccagggagtggggcgggaatggtttgctaatgaatgatcctgaactttataatctcgcggcataatttccaggggattatttgagagaaatacacaaaagtgagttttaacaaaggtatttatcaggccataaatgtgacctgcttcggataaaaaagattcagtatcgaaaaaccaatgatactcttgctgatggttaccaacagtaattaagatgtgatttgtttttccgtaatcgcaaaaatattgccatgaccataaaagaaaaattctcacaaaaatatccccatgcttccttttgtacttttggcgattcagcagcgttggccgatcacctcgcaacgttgattgcgactggtgttaaaacagcttcctgtggttcgctggcgggatgtattgaagacaacgcatttccgatgattggtgagtataagattgtagaaaatagccgtggtgagcctgtatgtgttatcagagtgattggcctgcatttactgcgcttttctgatgtcaccgtggagcttgcccgtaaggaaggtgaaggtgacctcagtcttgaatattggcgtaatgaacaccgtcgttttttccaggcagaaggaagctattcaccagaaatgcacgttatatttgaagaatatgcccttattgacgttgtgtagataactatttatctacgcgaaataaactcacacacataaaatatcgctaattttgtttattttgctattttttacgtgatgaatgtcacacttattgttgctgcccgttttgtccatatttataaccatatttttaatagctgcctgaaatagggctgtttattctgcataaaaatattcgaaaattcttattctctccagcgcgctaatttgggcgaacacttcctgactaccctgcaatgaggctgaaatgatgaataaacgttttgttatcaatatggtgtcttcgctgttattaggcgctgcgctaatttctgcgccgctccaggcagcggaaaaagtcgtggtgaatatttctaaagtcgatggtatgccgtggtttaatcgcatgggcgaaggtgtggttgaggcgggtaaagcctttggtgttaatgcctcacaggtggggccttcaagtactgatgctccgcaacaagttaaaattattgaggatttaatcgcccgtaaggttaatgcaattactatcgtgccaaacgatgccaacgtgctggaaccggtattcaaaaaagcgcgagatgccggaattgtggttctgaccaacgaatcccccggtcagccaagtgctaactgggatattgaaatcattgataacgaaaaatttgccgctgaatatgttgagcatatggcgaaacgcatggggggcaagggcggctatgtgatttacgtgggtagtttgaccgtgccgcagcataacttatgggctgacttgctggtgaaataccagaaagagcattacccggatatgcatgaagttacccgccgcatgccggttgccgagagtgtggatgactcacgtcgtaccacactggacctgatgaaaacctatcctgacttgaaagcggttgtctcctttggttcaaacggtccgattggcgcgggacgtgcggtgaaagagaaacgggcgaaaaataaagtcgcagtctatggcatgatgatcccttcacaggcggcatcactgattaaaagtggtgatatcaccgaagggattacttacgatccggcctctgcaggttacgcactcgcagccgtcgccagcacgttgctgaagggtgaagagatcaaacctggattagaaatgcagaatctgggtaaggccgacgtagatatggataagcgaattatccgtttccataaggtattactggtcaacaaagacaatatcgactcactttattaatccatttcttcggggcgaaagccccgattcttattgccaggggatgttatggaaactttcctttcccttcgtcatatcaacaaaacgtttcatgccacgcgagcgctgcgcgatgtttctctcgactttatgtcgggtgaagtgcactgccttgccgggcaaaacggctgtggtaaatcgacgttgattaaaattatgtccggtgtttatcgcccggatgagggagcggaaattacgcttggtgggaaaaactggtcaaagctgacacccgccgcttcggtggcgcaggggattcaggtgatttatcaggacctctctttatttcctaacctgagtgtctgggagaatatcgccgtgaatcactatcaccacggtctgtttgttaaccgccgtcgtctgcgtgaggtggcgcaggcggcaatgaccagtattaacgtcacattgccactggatacactcgtttctgagctttcaattgcccgctgtcagctggtggctatttgccgtgcactggcgcaggacgcacggttgatcgtgatggatgaaccaaccgcttcgctgacccatcaggaagtgcaagggttattacaggtggtgcatcaattgcgtgaacgcgggatctgcgtggtcttcgtcagtcatcgtctggaagaagtgatggaagtttccgaccgtatttcagtgctgaaagatggtgagctggtcgggacttttccggctgcagagatgaccacaaaacaactcggtttcctgatgaccggccaggagtttgaatatcaggtgcgagagttgtggcagggaaaatccagcaccccggtgctggaggtgcgtaatttaagtcgtcatggggaatatctaaatattaacttgcgggtggaagcgggcgaagtggtatcgattgttggcctgcttggtgcggggcgcacggaattatgtctgagtctgtttggtatgacccgaccggatgctggcgagatcctcatcaacggccagccggttacactgcatagtaaccaggacgctatccgccacggtattggttatgtttcggaagatcgcatgtcgcgcggtttggtgatggcgcaatctattgaagacaacatcattagcactgtttttcacaaggtaaaagatcgcttcggctttctgagtgaaactaaagttcgtgacctggtggacaggctaatcaaggcattgaccatcaaagtctctgatcctcatcttccggtgaatacgctttctggtggtaacgcgcagcgagtatcgatcgccaaatggctggcgattgggccacgactgttgattctcgatagcccgacagtcggtgttgatatcgccaacaaagcaggaatatacggcattatcagcgatctggcggctcatggcattgcggtattgatgatctgcgatgaaattgaagaagcgtggtatcaaagccaccggattttggtaatgcaaaaaggtcagatcacccatagcttcctgcctgacagcagttctcaggccaggattgcggaggtggtaaatggctgaactgaaaaaacgccatgaattctggctggcattactgattgtggtgctgtttgttggccttgcctggcgcagcgacgagtttctgacattcggtaatttgtacgatctcgccaataactatgccatgttgactattctcgcctgtggtttgtttgtggtgttgatttccggtggaattgatatttcgtttccagcaatgaccatcattgcgcaatacggcatggtgctgttgctgcaaaaaattggtggcaacttcgctgtcgcgtttgcactggcgggctgcatcggcattttacttggcttaattaacgccttactggttaatcgcctacgggtgccttctatcatcatcactatctcgacgctgaatattttctatggcctgctgttatggttgagtaaaggtgtgtggctgtacgactttccgccgtggtttgagcagggggttatgttgttcaagtacaccgatgctgatggctatgactatggccttggtctgccgctgatcgccatgattacggtggtgctgctaacagcgtttatcatgaatttcaccagtgtagggcgcaaaatttatgcccttggcgggaaccgcgaatcagccagtcgcatcggctttagcgtgctgaaactgcaacttttcgtctatggctatatgggattgatgtctggcgctgcgggtgtagtgcagtcgtggacggtgatgactgtcgcccccgattctcttctgggttatgagctgacagtactggctgcggtggtgcttggcggcactagtttgctcggcgggcgcggcacgttaaccggtactttgctcggcgtggtgttgttggcagtgatgcaaaacgggctaaatttattgggagtctcgtcttactggcaaacattgatcaccggcatcatcatcgttgccagcattagtgccacggcgtggagtcagcatcagaaccggagtctgctatgaaaaaatcgtggcgtaataacgttgagttttacttgatcggcctgctggtgctaactgttgccgcgttcagcattactatgccggagattttctggtcgataagtaatttccagtccgtcgcttcgcaaatgcccgtgctgggcattctggcgttggctatggcggtgaccatgctttgcggtggcattaacttgtcaattatagccactgctaacgcctgttcactggtgatggcgtgggtggcgactcagtatccaccgggtattgctacggttgtcgctacgttactggcgggcgctggcgcggcggtgataatcggtttatgtaacggcgtattgattgctggtattcgagtgtcgccaattcttgcaacgcttgggatgatgacgttgctcaaagggataaatattctggtgacaggtggtagcgccattgccaattatccctcatgggtgctgtggttgaatcatgcgcaatggttcggtattccgctaccgatgtggttgtttgccgcagtggcactggggctatggatattgctggagaaaacgccgctcggtaaagccatttacctgattgggtctaacgaacgagcaacactttactccggcattaacactcgtcgggtgctgatttgggtttatgtcatttccgccttgctttgtgcggtagcggcatttttgatgatgtcgaaactcaactcggctaaggcctcttatggcgaatcgtacttgctggtgtcaatcctcgcggcagtactcggtggggttaatccggacggcggcagcgggcggataattggtatggtgctggcgctgtttcttctgcaaattattgaaagcggcttcaatattctcggtataagcccctacctgacgatggccttatggggaacgttgctgctctgtttcattcaggttcgcggcatgttggggctggatcgggtggtttaaatattggctatattcaatggacgcgttttgccgcgatgacatatcaggcgtcgccaaatacacatagctaatcaggagtaaacacaatgaagatcaaagctgttggtgcatattccgctaaacaaccacttgaaccgatggatatcacacggcgtgaaccgggaccgaatgatgtcaaaatcgaaatcgcttactgtggcgtctgccattccgatctccaccaggtccgttccgagtgggcggggacggtttacccctgcgtaccgggtcatgaaattgtggggcgtgtggtagccgttggtgatcaggtagaaaaacatgcgccgggcgatctggtcggtgtcggctgcattgtcgacagttgtaaacattgcgaagagtgtgaagacgggctggaaaactactgtgatcacatgaccggcacctataactcgccgacgccggacgaaccgggccatactctgggcggctactcacaacagatcgtcgttcatgagcgatatgttctgcgtattcgtcacccgcaagagcagctggcggcggtggctcctttgttgtgtgcagggatcaccacgtattcgccgctacgtcactggcaggccgggccgggtaaaaaagtgggcgtggtcggcatcggcggtctgggacatatggggatcaagctggcccacgcgatgggggcgcatgtggtggcatttaccacttctgaggcaaaacgcgaagcggcaaaagccctgggggccgatgaagttgttaactcacgcaatgccgatgagatggcggctcatctgaagagtttcgatttcattttgaatacagtagctgcgccacataatctcaacgattttaccaccttgctgaagcgtgatggcaccatgacgctggttggtgcgcctgcgacaccgcataaatcgccggaagttttcaacctgatcatgaaacgccgtgcgatagccggttctatgattggcggcattccagaaactcaggagatgctcgatttttgcgccgaacatggcatcgtggctgatatagagatgattcgggccgatcaaattaatgaagcctatgagcgaatgctgcgtggtgatgtgaaatatcgttttgttatcgataatcgcacactaacagactgaaaaaattaataaataccctgtggtttaacatattaacttcgctctccacttaactttttagttaaggagagcgaaataatatcaaagtagcagtaaaacctataacgtaaattcaaattgttaaattaactccctccagtacacaatacttcacacgttagttatgagcgatttctgatagtgcctggtttaatcagagctttattatctgcgacgtttatttttatttaagagagatcgcgatgatatcattaaaagctccgcacaataatttgatgccatatacgcaacaaagcatacttaatacggttaaaaacaatcagttaccagaggatatcaaaagctccttggtttcctgtgtcgatatattcaaggttttgattaaacaatattatgattatccttatgattgtcgtgatgatttagtcgatgacgacaaactcattcatctcatggctgccgtacgagactgtgagtggtcagacgataacgcactcaccataaatgtacagtttaatgatttccctggattttatgactggatggattaccctgatcacccggttaagtttgtttttcgcatacttgaaaatcaaaaagggacagtttgggtatatgaccaggatgatgcgtttcttgatattaaagcaaatgtgcaggctggacgctttaccgggcttaagaaattagtgcagtttatcgattcagtgcgaacagattgcaaatgcattcttcttgaacaccatatgcctttgctgagacttttccctaaagggaaagagtgtatgcatgtggaaaaatggcttcgcgaaatgtcgtctattccggagacagacgcgcccattaagcaggcgcttgcgcatggattattattacacttaaaaaatatctaccctgtttttcctgaatcactggtgatgttattgctctctgttctggacgtaaaaacatacagagatgatgcacgattaaatgaatggatatcgaatagagtgcaggaattaggtgacagatattatcctgtaaataagcacgttaaaatccgctacactctttagttcagaaagggttccacctgcaagttgttattccaccagagagtgaatcgcaaagcaggtaatcatttcatctgtatatccgtatgccaaatggcattccaccgcctttttcgccgatattttgttgtgatcggcgacgcttcgcttaaaaaagcaccagcagtggtttcgcagctatgcggtgtataaaaaatgatctcatgcagatgttttgtgaatgtgtgggttgacattcatatgaaaaaaatcataattccatcatgtttgtgtggggtcttttctgtaccttagcatcgcactcaagcctgacagaaaatatgctgtaaggctcatatcaaaaaccgccattagctcatcaggaagagcagacgacaaccaggattgttgtatggtacggggttcgaggcctcgatggcggtccaacttttcaaaactcttctgaatcagatccccttattatcatccctgcaaagtggaacattgccattgtttggctattcaggacgggtcagaccaatgaaaaaagcccacacaggggagagtgggctgaaatgggaagctaaagactcaagtaaacttatcggaaataaggaccacgcattacgggggctatcatcgccgatggccgggattcggcaaatcaggttgattacgtagagagtaaattatctgctcaccgctgcgtcaccccttcgtaaatcaggcgtagcgcgaatacaccaataattgcaccaataacccgactggcaacgcgttgcatacgcccataagcacgacgcacagcgggcaaagaaaacgcctgactaagaaagactcgccagataactgatgcgagcacaatccccgcccaggccattaaacgtgcccatgttggtgtttcggcatttaatgttactgagaaaatactgataaaaaataaaacggtttgcgggttagagagatcggtaattaatccgcggcgaaaaaagacataccagggggcgctaatcggttgttgtagtgtgctcatttgcggtgttgactggcggcgcatgctgcaccacgcaaaccataagagataagcgccgccgacgattctgataagcgaaaaaatctcctcacactgcgtaattagtgttgcaagaccaaacaaacccaacccggaataaaatgcatcgcccagcgccacccccagcccggtcagcacacctgcgcgtcgaccggaagccaggctggtttgtactaccacaaagagattggctcccggattaaaaaaagtaatcacgaacagtcctacggtcaggtaaacggcgtgcaaaggatccatagtgatttcatccataaataagtgaagtaacttcatcatatttctaccaaaaataatcgggtgcgaaagagatcacaaagtgtcttatttccggttactggcgtttatgccctgactgaactaattattaatcaacccaataatgtgggtgggtgatagtgtgataacaactctggagccgtaatatgaaaataatctctaaaatgttagtcggtgcgttagcgtttgccgttaccaatgtctatgccgctgaattgatgaccaaagcggaatttgaaaaagttgaatcgcagtatgaaaaaataggtgatatttcaaccagtaatgaaatgtcgaccgcagatgcgaaagaggatttgatcaaaaaagcggatgaaaaaggggctgatgtgttggtactgacctctggtcaaactgacaataagatccacggcacggcaaatatttataagaagaagtaattctgaaacctatgtaaacatccccgatgcgtaaatttatcggtgatcatcatctattgaaatttatgccggataaagcgttcgcgctgcattcggcagttcagtttttcagccgccgccagaacgtcgtccggcttatgcctaaataattcgccgctgctgttttatcgcctttaaatttctccagtgcctgttgtggtgtcagtaagcgtggagcgggaattttcgccgactcgcgcgccagctccggcagtagcagttgcataaactgcggcgttaaatccggcgtcggttccacacttaaaaacagcgccagtcgttccatcatattgcgcagttcacgaatattgcctggccagtcgtagtgcaccagcacggtttcgcttgcctgtaatccctggcgtaatgcggcagaaaacggggcggagagcgccgccagagacactttcaaaaagctttccgccagcggaagaatatccgccacccgctcgcgcagtggtggcaattgcagacgcaaaatactcagccgataaaacagatcacggcgaaactgcccttgccgcatatcttcttccagattgcagtgagtggcgctaatgacccgcacatccaccggaacaggctgatgcccgccgacgcgagtaacctctttttcttccagcacccgtaacaggcgagtctgcaaaggtagcggcatttcgccaatctcatccagaaacagcgtaccgccgtgggcaatttcgaacagcccggcgcgacctccgcgtcgcgagccggtaaacgccccttcctcatagccaaacagctccgcttccagcagcgattcggctatcgccccgcagttgacggcaacaaacggatgcgactttttgccctgtcgcgcatcgtggcgggcaaaatattcccgatgaatcgcctgggccgccagctctttgcccgtccccgtttccccttcaatcaacaccgccgcactggagcgggcatacagcaaaatagtctgccgtacttgttccatctgtggtgattgaccgagcatatcgcccagcacgtaacgagttctcagggcgttgcgggtggcatcgtgagtgttatggcgtaacgacatgcgcgtcatatccagcgcatcgctgaacgcctggcgcacggtgacggcggaatagataaaaattccggtcattccggcttcttctgccagatcggtaatcagccccgcaccgaccaccgcttcggtgccgttagctttgagctcgttaatctgcccgcgggcgtcttcttcggtaatgtagctacgttgatcgaggcgcaaattaaaggttttttgaaacgccaccagtgccggaatagtttcctgataagtgacaacgccgatagaagaggtgagctttccggcttttgccagtgcctgtaacacatcgtagccgctcggtttaatcaaaataactggcactgacaggcggcttttcaggtacgcgccgttagagccagcggcgatgacggcgtcgcagcgttcgtttgccagtttcttgcggatataggtcactgctttttcaaagccaagctggataggggtaatgttcgccaggtgatcaaactcgaggctgatatcgcgaaacagctcgaacaggcgcgttacagataccgtccagataaccggtttgtcgtcattaagccgtggtggatgtgccatagcgcaccgcaaagttaagaaaccgaatattgggtttagtcttgtttcataattgttgcaatgaaacgcggtgaaacattgcctgaaacgttaactgaaacgcatatttgcggattagttcatgactttatttataacaaattgaaattaaacatttaattttattcagttaattgtggcacaccccttgctttgtctttatcaacgcaagtaacaagttgataacaaaggatgggctatgtctctacactctccaggtaaagcgtttcgcgctgcactgtctaaagaaaatccattgcagattgttggcaccatcaacgctaatcatgcgctgttggcgcagcgtgccggatatcaggcaatttatctctccggcggtggcgtggcggcaggttcgctggggctgcccgatctcggtatttctacccttgatgatgtgctgaccgacattcgccgtatcaccgacgtttgttcgctgccgctgctggtggatgcggatatcggttttggttcttcggcctttaacgtggcgcgtacggtgaaatcgatgattaaagccggtgcggcaggattgcatattgaagatcaggttggtgcgaaacgctgcggtcatcgcccgaacaaagcgatcgtctcgaaagaggagatggtggatcggatccgcgcggcggtggatgcgaaaaccgatcctgattttgtgatcatggcgcgcaccgatgcgctggcggtagaggggctggatgcggcgatcgagcgtgcacaggcctatgttgaagcgggtgccgagatgttgttcccggaggcgattaccgaactcgccatgtaccgccagtttgccgatgcggttcaggtgccaatcctcgccaacattaccgaatttggtgccacgccgctgtttaccaccgacgaattacgcagcgcccatgtcgcaatggcgctgtacccgctttcagcgttccgcgccatgaaccgcgccgctgaacatgtctacaacgtcctgcgccaggaaggcacgcagaaaagcgtcatcgacaccatgcagacccgcaacgaactgtacgaaagcatcaactactaccagtacgaagagaagctcgacgacctgtttgcccgtagccaggtgaaataaaacacaacgaaaaatatctcgaccctacaaatgacgaggacaatatgagcgacacaacgatcctgcaaaacagtacccatgtcattaaaccgaaaaaatcggtggcactttccggcgttccggcgggcaatacggcgctctgcaccgtgggtaaaagtggcaatgacctgcattaccgtggctacgatattcttgatctggcggaacattgcgaatttgaagaagtggctcatctgctgatccacggcaaactgccgacccgtgacgaactcgccgcttacaaaacgaaactgaaagccctgcgtggtttaccggctaacgtgcgtaccgtgctggaagccttaccggcggcgtcacacccgatggatgttatgcgcaccggtgtttccgcgctcggctgcacgctgccagaaaaagaggggcataccgtctctggcgcgcgggatattgccgacaaactgctggcgtcgcttagctcgattctcctttattggtatcactacagccacaacggcgaacgcatccaaccggaaaccgatgacgactccatcggcggtcacttcctgcatctgctgcacggcgaaaagccatcgcaaagctgggaaaaggcgatgcatatctcgctggtgctgtacgccgaacacgagtttaacgcctccacctttaccagtcgggtgattgcgggcaccggctctgatatgtattccgcgattattggcgcgattggcgcactgcgcgggccaaaacacggcggggcgaatgaagtgtcgctggagatccagcaacgctacgaaacgccggacgaagccgaagcagatatccgcaagcgcgtggaaaacaaagaagtggtcattggttttggtcatccggtttacaccatcgctgacccgcgccaccaggtgattaaacgtgtggcgaagcagctctcgcaggaaggcggctcgctgaagatgtacaacatcgccgatcgcctggaaacggtgatgtgggagagcaaaaagatgttccccaatctcgactggttctctgctgtttcctacaacatgatgggcgttcccaccgagatgttcacaccactgtttgttatcgcccgcgtcaccggctgggcggcgcacattatcgaacaacgtcaggacaacaaaattatccgtccttccgccaattatgttggaccggaagaccgcccgtttgtcgcgctggataagcgccagtaaacctctacgaataacaataaggaaacgtacccaatgtcagctcaaatcaacaacatccgcccggaatttgatcgtgaaatcgttgatatcgtcgattacgtcatgaactacgaaatcagctctaaagtggcctacgacaccgcacattactgcctgctcgacacgctcggctgcggtctggaagctctcgaatacccggcctgtaaaaaactgctggggccaattgttcccggcaccgtcgtacccaacggcgtgcgcgtccccggaactcagttccagctcgaccccgtccaggcggcatttaacatcggcgcgatgatccgctggctcgatttcaacgatacctggctggcggcggagtggggccatccttccgacaacctcggcggcattctggcaacggcggactggctttcgcgcaacgcggtcgccagcggcaaagcgccgttgaccatgaaacaggtgctgaccgcaatgatcaaagcccatgaaattcagggctgcatcgcgctggaaaactcctttaaccgcgtcggcctcgaccacgttctgttagtgaaagtggcttccaccgccgtggtcgccgaaatgctcggcctgacccgcgaggaaattctcaacgccgtttcgctggcgtgggtggacggtcagtcgctgcgcacctatcgccatgcgccgaacaccggcacgcgtaaatcctgggcggcgggcgatgccacttcccgcgcggtacgtctggcactgatggcgaaaacgggcgaaatgggttacccgtcagccctgactgcgccggtgtggggcttctacgacgtctcctttaaaggtgaatcgttccgcttccagcgcccgtacggttcctacgttatggaaaatgtgctgttcaaaatctccttcccggcggagttccactcccagacggcagttgaagcagcgatgacgctctatgaacagatgcaggcagcaggcaaaacggcggcggatatcgaaaaagtgaccattcgcacccacgaagcctgtattcgcatcatcgacaaaaaaggaccgctcaataacccggcagaccgcgatcactgcattcagtacatggtggcgatcccgctgctgttcgggcgcttaacggcggcagattacgaggacaacgtggcgcaagataaacgtatcgacgccctgcgcgagaagatcaattgctttgaagatccggcatttaccgctgactaccacgacccggaaaaacgcgccatcgccaatgccattacccttgagttcaccgacggcacacgatttgaagaagtggtggtggagtaccccattggtcatgctcgccgccgtcaggatggtattccgaaactggtcgataaattcaaaatcaatctcgcgcgccagttcccgactcgccaacagcagcgcattctggaggtttctctcgacagaactcgcctggaacagatgccggtcaatgagtatctcgacctgtacgtcatttaagcaaacagcggtaaggcgtaagttcaacaggagagcattatgtcttttagcgaattttatcagcgttcgattaacgaaccggagcagttctgggccgagcaggcccggcgtattgactggcagacgccctttacgcaaacgctcgatcacagcaatccgccgtttgcccgttggttttgtgaaggccgaaccaacttgtgccacaacgctatcgaccgctggctggagaaacaaccagaggcgctggcgctgattgccgtctcttcggaaacagaagaagagcgcacctttacctttcgtcagcttcatgacgaagtaaacgcggtggcgtcaatgctgcgctcgctgggcgtgcagcgtggcgatcgggtgctggtgtatatgccgatgattgccgaagcgcatattactctgctggcctgcgcgcgcattggcgctattcattcggtggtgtttgggggatttgcctcgcacagcgtggcggcgcgaattgatgatgctaaaccggtgctgattgtctcggctgatgccggagcgcgcggtggcaaaatcattccctataaaaaattgctcgacgatgcgataagtcaggcgcagcaccagccacgccatgttttgctggtggatcgcgggctggcgaaaatggcacgcgtcagcgggcgggatgtcgatttcgtgtcgttgcgccatcaacacatcggcgcgcgggtaccggtggcgtggctggaatccaacgaaacctcctgcattctctacacctccggcacgaccggcaaacctaaaggcgtgcagcgtgacgtcggcagatatgcggtggcgctggcgacctcgatggacaccatttttggcggcaaagcgggcggtgtgttcttttgtgcttcggatatcggctgggtggtggggcattcgtatatcgtctacgcgccgctgctggcggggatggcgactatcgtttacgaaggattaccgacctggccggactgcggcgtgtggtggaaaatcgtcgagaaatatcaggttagccggatgttctcagcgccgaccgccattcgcgtgctgaaaaaattccctaccgctgaaattcgcaaacacgatctctcgtcgctggaagtgctctatctggctggagaaccgctggacgagccgaccgccagttgggtgagcaatacgctggatgtgccggtcatcgacaactactggcagaccgaatccggctggccgattatggcgattgctcgcggtctggacgacaggccgacgcgtctgggaagccccggtgtgccgatgtatggctataacgtgcagttgcttaatgaagtcaccggcgaaccgtgtggcgtcaacgagaaagggatgctggtggtggaagggccgctgccgccggggtgtattcagaccatctggggcgacgacggccgctttgtgaagacttactggtcgctgttttcccgcccggtgtacgccacctttgactggggcatccgtgacgctgacggttatcactttattctcgggcgcactgacgatgtaattaacgttgccgggcatcggctggggacgcgcgagattgaagagagtatctccagccatccgggcgttgccgaagtggcggtggttggggtgaaagatgcgctgaaagggcaggtggcggtggcgtttgtcattccgaaagagagcgacagtctggaagatcgtgatgtggcgcactcgcaagagaaggcgattatggcgctggtggacagccagattggcaactttggccgcccggcgcacgtctggtttgtctcgcaattgccaaaaacgcgatccggaaaaatgctgcgccgcacgatccaggcgatttgcgaaggacgcgatcctggggatctgacgaccattgatgatcctgcgtcgttggatcagatccgccaggcgatggaagagtaaggtattgtcggatgcgtcgcgtggcgcatccgacaccatgcgccgatgcctgatgcgacgcttaccgcgtcttattatgcctacccactgtttttacaccgataatttttcccccacctttttgcactcattcatataaaaaatatatttccccacgaaaacgattgctttttatcttcagatgaatagaatgcggcggattttttgggtttcaaacagcaaaaagggggaatttcgtgtcgcaagataacaactttagccaggggccagtcccgcagtcggcgcggaaaggggtattggcattgacgttcgtcatgctgggattaaccttcttttccgccagtatgtggaccggcggcactctcggaaccggtcttagctatcatgatttcttcctcgcagttctcatcggtaatcttctcctcggtatttacacttcatttctcggttacattggcgcaaaaaccggcctgaccactcatcttcttgctcgcttctcgtttggtgttaaaggctcatggctgccttcactgctactgggcggaactcaggttggctggtttggcgttggcgtggcgatgtttgctattccggtgggcaaggcaaccgggctggatattaatttgctgattgccgtttccggtttactgatgaccgtcaccgtcttctttggcatttcggcgctgacggttctttcggtgattgcggttccggctattgcctgccttggcggttattccgtgtggctggccgttaacggcatgggcggcctggacgccttaaaagcggtcgttcccgcacaaccgttagatttcaatgtcgcgctggcgctggttgtggggtcatttatcagtgcgggtacgctcaccgctgactttgtccggtttggtcgcaatgccaaactggcggtgctggtggcgatggtggcctttttcctcggcaactcgttgatgtttattttcggtgcagcgggcgctgcggcactggggatggcagatatctctgatgtgatgattgctcagggactgctgctgcccgcgattgtggtgctggggctgaatatctggaccaccaacgataacgcactctatgcgtcgggtttaggtttcgccaacattaccggtatgtcgagcaaaaccctttcggtaatcaacggtattatcggtacggtctgcgcattatggctgtataacaattttgtcggctggttgaccttcctttcggcagctattcctccggtagggggcgtgatcatcgccgactatctgatgaaccgtcgccgctatgagcactttgcgaccacgcgtatgatgagtgtcaattgggtggcgattctggcggtcgcgctggggattgccgcaggccactggttaccgggaattgttccggtcaacgcggtattaggtggcgcgctgagctatctgatccttaacccgattttgaatcgtaaaacgacagcagcaatgacgcatgtggaggttaacagtgtcgaataacgctttacaaacaattattaacgcccggttaccaggcaaagaggggctgtggcagattcatctgcaggacggaaaaatcagcgccattgatgcgcaatccggcgtgatgcccataactgaaaacagcctggatgccgaacaaggtttagttataccgccgtttgtggagccgcatattcacctggacaccacgcaaaccgccggacaaccgaactggaatcagtccggcacgctgtttgaaggcattgaacgctgggccgagcgcaaagcgttattaacccatgacgatgtgaaacaacgcgcctggcaaacgctgaaatggcagattgccaacggcattcagcatgtgcgtacccatgtcgatgtttcggatgcaacgctaactgcgctgaaagcaatgctggaagtgaagcaggaagtcgcgccgtggattgatctgcaaattgtcgccttccctcaggaagggattttgtcgtatcccaacggtgaagcgttgctggaagaggcgttacgcttaggggcagatgtagtgggggcgattccgcattttgaatttacccgtgaatacggcgtggagtcgctgcataaaaccttcgccctggcgcaaaaatacgaccgtctcatcgacgttcactgtgatgagatcgatgacgagcagtcgcgctttgtcgaaaccgttgctgccctggcgcaccgtgaaggcatgggcgcgcgagtcaccgccagccacaccacggcaatgcactcctataacggggcgtatacctcacgcctgttccgcttgctgaaaatgtccggtattaactttgtcgccaacccgctggtcaatattcatctgcaaggacgtttcgatacgtatccaaaacgtcgcggcatcacgcgcgttaaagagatgctggagtccggcattaacgtctgctttggtcacgatgatgtcttcgatccgtggtatccgctgggaacggcgaatatgctgcaagtgctgcatatggggctgcatgtttgccagttgatgggctacgggcagattaacgatggcctgaatttaatcacccaccacagtgccagaacgttgaatttgcaggattacggcattgccgccggaaacagcgccaacctgattatcctgccggctgaaaatgggtttgatgcgctgcgccgtcaggttccggtacgttattcggtacgtggcggcaaggtgattgccagcacacaaccggcacaaaccaccgtatatctggagcagccagaagccatcgattacaaacggtaatttcctctgtgttgaagagccactgacctgtgtcagtggctaccgtgattcattctcgccaacatccgcacattcctccaacgccatgtgcaaaaatgccttcgcggcggctgtctgccagctatttttccgccgcaacaaaaccgccgttctctccagtagtggcggggcaagagaaatcgctttaagcccgtcatgttgtgtggcaatcgctgctggtaacaatgtggaaagggaagtgcggcgaatcagctccagaaccgcgctaattgagttcgcctcaatgaccacctgtggatgtagccccgctttctcgcagtagtggtcaatttgctctctggtggcaaattccgcgctgagcaggaccagtttttcatcatgcaagcgactcaacgccacctgttcacaggcagccagcggatgatgttgcgccacgactaacgctaaactttctgtcagtaaaggaattgcctccagctccggcgaatgcacaggcgcgaaggcaatcccaacgtccagctcgtcgcgacaaagcagatcttcgattttctcctgcgacatttcctgtagctggagcgtgatgccggggtagcgcgcatagaaatccgccattaaagggccgataaagtagcttgtaaaggtgggggtgacggcgatacgcagcgatcctcgcgtcagatcggcaacatcatgaatcgcccgtttacccgctcccagttcctgtaacgcccggctggcgtactgtcgccagacttctcctgcatcggtgagacgaatcgttcgcccgctacggtcaaacagcggcacgcctaaactctcctctaactggcgaatctgctgggaaagcgcaggctgagagacgtgcaacgcactggcggcacgggtgaagctgccatgttcagccacggcaagaaaataattgatatgtcgagagagcattcgccaacctataagtaaatccaatagaactcatcataaatgagacttttaccttatgacaatcggcgagtagtctgcctctcattccagagacagacagaggttaacggtgaaagagattattgatggattccttaaattccagcgcgaggcatttccgaagcgggaagccttgtttaaacagctggcgacacagcaaagcccgcgcacactttttatctcctgctccgacagccgtctggtccctgagctggtgacgcaacgtgagcctggcgatctgttcgttattcgcaacgcgggcaatatcgtcccttcctacgggccggaacccggtggcgtttctgcttcggtggagtatgccgtcgctgcgcttcgggtatctgacattgtgatttgtggtcattccaactgtggcgcgatgaccgccattgccagctgtcagtgcatggaccatatgcctgccgtctcccactggctgcgttatgccgattcagcccgcgtcgttaatgaggcgcgcccgcattccgatttaccgtcaaaagctgcggcgatggtacgtgaaaacgtcattgctcagttggctaatttgcaaactcatccatcggtgcgcctggcgctcgaagaggggcggatcgccctgcacggctgggtctacgacattgaaagcggcagcatcgcagcttttgacggcgcaacccgccagtttgtgccactggccgctaatcctcgcgtttgtgccataccgctacgccaaccgaccgcagcgtaaccttatttttaaaccatcaggagatccaccatgattcagtcacaaattaaccgcaatattcgtcttgatcttgccgatgccattttgctcagcaaagctaaaaaagatctctcatttgccgagattgccgacggtaccggtctggcagaagccttcgtaaccgcggctttgctggggcagcaagcgcttcctgccgacgccgcccgcctggtcggggcgaagctggatctcgacgaagacgccattctactgttgcagatgattccactgcgtggctgcattgatgaccgtattccaaccgacccaacgatgcatcgtttctatgaaatgttgcaggtgtacggcacaaccctgaaagcgttggttcatgagaagtttggcgatggcattatcagcgcgattaacttcaaactcgacgttaagaaagtggcggacccggaaggtggcgaacgtgcggtcattaccttagatggtaaatatctgccgaccaagccgttctgacagccatgcgcaatcatcaaaagacgttcacgatgctgctggttctggtgctgattggtcttaatatgcgaccactgctcacctccgtcgggccactgctaccgcaattgcgccaggcgagcggaatgagctttagcgtggctgccctgttgaccgctcttccggtggtcaccatgggcgggctggcgctggccggaagctggcttcatcagcatgtcagcgaacgtcgcagtgtcgccatcagtctgttgctgattgccgtcggtgcattgatgcgtgagctttacccccaaagtgcgctgctgcttagcagcgcactgctcggtggggtggggatcggcatcattcaggcggtgatgccttcggtgattaaacggcggtttcagcagcgcacgccactggtgatggggctgtggtccgcggctctgatgggcggcggtggacttggtgccgccataacgccctggttagttcaacatagcgaaacctggtatcaaacactcgcctggtgggcgctgcctgccgttgttgcgctctttgcctggtggtggcaaagcgcccgcgaggtcgcctcttcccacaagacaacaaccactccggttcgcgtggtatttactccccgcgcctggacgctgggcctatacttcggtctgattaacggtggttacgccagcctgattgcctggttacccgctttctatattgagattggtgccagcgcgcagtacagcggttccttgctggcattgatgacgcttgggcaagccgcaggagctttgctgatgcctgctatggctcgccatcaggatcggcgcaaacttttgatgctggcgctggcgttacaactggtgggtttctgcggctttatctggctgccgctgcaattgccggtattgtgggcgatggtgtgtgggttaggtctgggtggcgcatttccgctctgtttgctgctggcgctcgatcactctgcgcaacctgctattgctggcaagctggtggcgtttatgcaggggatcggttttatcatcgccgggcttgccccgtggttttctggtttgctgcgtagtatcagcggcaattacctgatggactgggcatttcatacgctgtgcgtcgttgggctgatgatcataaccctgcgttttgcaccagcacgttttccgcagctgtgggtcaaagaggtatgatgcgacgcttgtttcgccagatgatggagctataaataattgtcggatgtgcccagtggcgcatccgacattaattgcttaagcgacttcattcacctgacgacgcagcagggaaagcgggccggggccgctaagcgtgaacacggaaattaaggtgaagcccagcgccaccagacccagcaccagataagcgccctggaaaccgatgctttcatacatattgcccgccagtacagacataaaaatcatcgccagttgcttaaagaagcagaaacagaccagataaatcgtcgctgaaaaacgcacttcaaactggctggtaatatatttaaagcagcccaccagcaggaacggtacttcaaacatatgcagcgttttcagaataaccacttccagcgctgaggtggcgaacgatgagccaataatacgtacagacataatagtgccagccagcagcagggcgtttttcccaccgatgcgattaatgatcagtggcgcaaagaacataatcgaggcgttaagtaattcgcccattgtcgttacgtagccaaatacccgcgtaccctgttcaccggtggcaaagaaagaagtaaagaaattagcaaactgttggtcaaaaacatcgtaggtgcaggaaacgccaataacatacagtgacaaaaaccacagttttggctgtctgaacagttccagcgccagtttaaggctaaatgccgaatggttggcacctaccgcattggcaaccgtggcggaagagggcgcatccgttttggcgaaaaagagtaaaatggcgaggatgagtgcacagccagaacccagccagaaaacgaactgattattgatggtgaacatgatgccgacaatcgaggcacacagcgcccagccaacacagccaaacatccgcgcgcgaccaaattcgaaattactgcgacggctgactttctcgataaatgcctctactgcgggcgcaccggcgttaaaacaaaagcctagataaataccaccaacaatcgatcctactaaaatgttgtattgtaacagtggcccgaagataaaaataaagaacggcgcaaacatcactaacatgccggtaataatccacagcaggtatttgcgcagcccgagtttgtcagaaagcagaccaaacagcggttggaataatagcgagaacagagaaatagcagcaaaaataatacccgtatcacttttgctgatatggttgatgtcatgtagccaaatcgggaaaaacgggaagtaggctcccatgataaaaaagtaaaagaaaaagaataaaccgaacatccaaaagtttgtgttttttaaatagtacataatggatttccttacgcgaaatacgggcagacatggcctgcccggttattattatttttgacaccagaccaactggtaatggtagcgaccggcgctcagctggaattccgccgatactgacgggctccaggagtcgtcgccaccaatccccatatggaaaccgtcgatattcagccatgtgccttcttccgcgtgcagcagatggcgatggctggtttccatcagttgttgttggctgtagcggctgatgttgaactggaagtcgccgcgccactggtgtgagccataattcaattcgcgcgtcccgcagcgcagaccgttttcgctcgggaagacgtacggggtatacatgtctgacaatggcacatcccagcggtcaaaacaggccgcagtaaggcggtcgggatagttttcttgcggccctaatccgagccagtttacccgctctgctacctgcgccagctggcaggtcaggccaatccgcgccggatgcggtgtatcgctcgctacttcaacatcaacggtaatcgccatttgaccactaccatcaatccggtaggttttccggctgataaataaggtttttccctgatgctgccacgcgtgagcggtcgtaatcagcaccgcgtcggcaagtgtatctgccgtgcactgcaacaacgctgcttcggcctggtaatggcccgccgccttccagcgttcgacccaggcgttcgggtcaatacgggtcgcttcacttacgccaatgtcgttatccagcggtgcacgggtgaactgatcgcgcagcggcgtcagcagttgtttttcatcgccaatccacatctgtgaaagaaggcctgactgacggttaaattgccaacgcttattacccagctcgatgcaaaaatccgtttcgctggtggttagttgcgggatgatatgggacgcggaggggagcgtcacactgaggttttccgccagacgccactgctgccaggcgctgatgtgcccggcttctgaccatgcggtcgcgttcggttgcactacgcgtactgtgagccagagttgcccggcgctctccggctgcggtagttcaggcagttcaatcaactgtttaccttgtggagcgacatccagaggcacttcaccgcttgccagcggcttaccatccagcgccaccatccagtgcaggagctcgttatcgctatgacggaacaggtattcgctggtcacttcgatggtttgcccggataaacggaactggaaaaactgctgctggtgttttgcttccgtcagcgctggatgcggcgtgcggtcggcaaagaccagaccgttcatacagaactggcgatcgttcggcgtatcgccaaaatcaccgccgtaagccgaccacgggttgccgttttcatcatatttaatcagcgactgatccacccagtcccagacgaagccgccctgtaaacggggatactgacgaaacgcctgccagtatttagcgaaaccgccaagactgttacccatcgcgtgggcgtattcgcaaaggatcagcgggcgcgtctctccaggtagcgaaagccattttttgatggaccatttcggcacagccgggaagggctggtcttcatccacgcgcgcgtacatcgggcaaataatatcggtggccgtggtgtcggctccgccgccttcatactgcaccgggcgggaaggatcgacagatttgatccagcgatacagcgcgtcgtgattagcgccgtggcctgattcattccccagcgaccagatgatcacactcgggtgattacgatcgcgctgcaccattcgcgttacgcgttcgctcatcgccggtagccagcgcggatcatcggtcagacgattcattggcaccatgccgtgggtttcaatattggcttcatccaccacatacaggccgtagcggtcgcacagcgtgtaccacagcggatggttcggataatgcgaacagcgcacggcgttaaagttgttctgcttcatcagcaggatatcctgcaccatcgtctgctcatccatgacctgaccatgcagaggatgatgctcgtgacggttaacgcctcgaatcagcaacggcttgccgttcagcagcagcagaccattttcaatccgcacctcgcggaaaccgacatcgcaggcttctgcttcaatcagcgtgccgtcggcggtgtgcagttcaaccaccgcacgatagagattcgggatttcggcgctccacagtttcgggttttcgacgttcagacgtagtgtgacgcgatcggcataactaccacgctcatcgataatttcaccgccgaaaggcgcggtgccgctggcgacctgcgtttcaccctgccataaagaaactgttacccgtaggtagtcacgcaactcgccgcacatctgaacttcagcctccagtacagcgcggctgaaatcatcattaaagcgagtggcaacatggaaatcgctgatttgtgtagtcggtttatgcagcaacgagacgtcacggaaaatgccgctcatccgccacatatcctgatcttccagataactgccgtcactccagcgcagcaccatcaccgcgaggcggttttctccggcgcgtaaaaatgcgctcaggtcaaattcagacggcaaacgactgtcctgaccgtaaccgacccagcgaccgttgcaccacagatgaaacgccgagttaacgccatcaaaaataattcgcgtctggccttcctgtagccagctttcatcaacattaaatgtgagcgagtaacaacccgtcggattctccgtgggaacaaacggcggattgaccgtaatgggataggtcacgttggtgtagatgggcgcatcgtaaccgtgcatctgccagtttgaggggacgacgacagtatcggcctcaggaagatcgcactccagccagctttccggcaccgcttctggtgccggaaaccaggcaaagcgccattcgccattcaggctgcgcaactgttgggaagggcgatcggtgcgggcttcttcgctattacgccagctggcgaaagggggatgtgccgcaaggcgattaagttgtgtaacgccagggttttcccagtcacgacgttgtaaaacgacggccagtgaatccgtaatcatggtcatagctgtttcctgtgtgaaattgttatccgctcacaatttcacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactatcgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttctcgcgttttcgcagaaacgtggctggcctggttcaccacgcgagaaacggtctgataagagacaccggcatactctgcgacatcgtatagcgttactggtttcacattcaccaccctgaattgactctcttccgggcgctatcatgccataccacgaaaggttttgcgccattcgatggtgtcaacgtaaatgcacgccgcttcgccgtccggccaccagaatagcctgcgattcaaccccttcttcgatctgttttgctacccgttgtagcgccggaagatgcttttccgctgcctgttcaatggtcattgcgctcgccatatacaccagattcagacagccaatcacccgttgttcactgcgcagcggtacggcgatagaggcgatcttctcctcctgatcccagccgcggtagttctgtccgtaaccctctttgcgcgcgcgcgccagaatggcttgcagctttaacggttctcgtgccagttgatagtcatcaccggggcgggcggctaacatttcgattaattccttgcgttcttgttccgggcaaaaggccagccaggtcaggcccgaggcggttttcaggagcggtaaacgtcgcccgaccattgcccggtgaaaggataagcggctgaaacggtgggtggtttcgcgtaccaccattgcatcaacatccagcgtggacacatctgtcggccataccacttcgcgcaacagatcgcccagcagcggggccgccagtgcagaaatccactgttcgtcacgaaatccttcgcttaattgccgcactttgatggtcagacgaaaactgtcatcggaggggctacggcggacatatccctcttcctgcagcgtctccagcagtcgccgcacagtggtgcgatgcaggccgctgagttccgccagcagcccgacgctggcaccgccatcaagtttatttaacatatttaataacattagaccgcgtgttaagccgcgcacggttttgtattccgtctgctcattgttctgcatattaattgacatttctatagttaaaacaacgttgtgcacctggtgcacattcgggcatgttttgattgtagccgaaaatacccttcctatactgagcgcacaataaaaaatcatttacatgtttttaacaaaataagttgcgctgtactgtgcgcgcaacggcattttgtccgagtcgtgaggtactgaaatggcaatacaacaccctgacatccagcctgctgttaaccatagcgttcaggtggcgatcgctggtgccggtccggttgggctgatgatggcgaactatctcggtcagatgggcattgacgtgctggtggtggagaaactcgataagttgatcgactacccgcgtgcgattggtattgatgacgaggcgctgcgcaccatgcagtcggtcggcctggtcgagaatgttctgccgcacactacaccgtggcacgcgatgcgttttctcaccccaaaaggccgctgttttgctgatattcagccaatgaccgatgaatttggctggccgcgccgtaacgcctttattcagccacaggtcgatgcggtgatgctggaagggttgtcgcgttttccgaatgtgcgctgcttgtttgcccgcgagctggaggccttcagccagcaaaatgacgaagtgaccttgcacctgaaaacggcagaagggcagcgggaaacggtcaaagcccagtggctggtagcctgtgacggtggagcaagttttgtccgtcgcactctgaatgtgccgtttgaaggtaaaactgcgccaaatcagtggattgtggtagatatcgccaacgatccgttaagtacgccgcatatctatttgtgttgcgatccggtgcgcccgtatgtttctgccgcgctgcctcatgcggtacgtcgctttgaatttatggtgatgccgggagaaaccgaagagcagctgcgtgagccgcaaaatatgcgcaagctgttaagcaaagtgctgcctaatccggacaatgttgaattgattcgccagcgtgtctacacccacaacgcgcgactggcgcaacgtttccgtattgatcgcgtactgctggcgggcgatgccgcgcacatcatgccggtatggcaggggcagggctataacagtggtatgcgcgacgcctttaacctcgcatggaaactggcgttggttatccaggggaaagcccgcgatgcgctgctcgatacctatcaacaagaacgtcgcgatcacgccaaagcgatgattgacctgtccgtgacggcgggcaacgtgctggctccgccgaaacgctggcagggtacgttacgtgacggcgtttcctggctgttgaattatctgccgccagtaaaacgctacttcctcgaaatgcgcttcaagccgatgccgcaatattacggcggtgcgctgatgcgtgagggcgaagcgaagcactctccggtcggcaagatgtttattcagccgaaagtcacgctggaaaacggcgacgtgacgctgctcgataacgcgatcggcgcgaacttcgcggtaattggctggggatgcaatccactgtgggggatgagcgacgagcaaatccagcagtggcgcgcgttgggcacacgcttcattcaggtggtgccggaagtgcaaattcataccgcacaggataaccacgacggcgtactacgcgtgggcgatacgcaaggtcgcctgcgtagctggttcgcgcaacacaatgcttcgctggtggtgatgcgcccggatcgctttgttgccgccaccgccattccgcaaaccctgggcaagaccctgaataaactggcgtcggtgatgacgctgacccgccctgatgccgacgtttctgtcgaaaaggtagcctgatatgcacgcttatcttcactgtctttcccactcgccgctggtggggtatgtcgacccggcgcaagaggtgctcgatgaggtcaatggcgtgattgccagcgcccgcgagcgtattgcggcattctcccctgaactggtggtgctgtttgcgccagatcactacaacggctttttctatgacgtgatgccaccgttctgtttaggcgttggagcgacggcaattggtgatttcggcagtgcggcaggagagctgcccgtgcctgtggagctggcggaggcctgtgcgcatgctgtcatgaagagcgggatcgatcttgccgtttcttactgtatgcaggtggaccacgggttcgcccagccgctggagttcctgctcggtgggctggataaggtgccagttctgcctgtgttcatcaacggtgtcgccacgccgctgcccggtttccagcgtacccgcatgttgggtgaagccattggacgtttcaccagcactctcaataaacgcgtgctgttcctgggttccggtgggctttcccatcagccgccggtgcccgaactggcgaaagccgatgcccatatgcgcgaccgtctgttggggagcgggaaagatttacccgccagtgagcgcgaattgcgtcagcaacgggtgattagcgccgctgagaagtttgttgaggatcagagaactctgcatccgctcaacccgatttgggataaccagttcatgactttgctggagcagggacgcatacaggaactggatgccgtcagtaacgaagagctttccgccattgccggaaagtcgacacatgaaatcaaaacctgggtcgccgcttttgccgctatttctacatttggcaactggcgtagcgaagggcgttattaccgcccaatcccggagtggattgccggatttggctcgttaagcgccagaacagagaactgaatatgcaggagaagatgatgagttatcagccacaaaccgaagccgccaccagccgttttctgaatgtagaagaagcgggtaaaacgctgcgcatccattttaatgactgcggacaaggcgacgaaaccgttgtcctgctgcatggttccggcccgggtgctactggctgggcgaacttcagccgcaatatcgatccgctggtagaggcgggctatcgggtaatcctgctggattgtccgggttggggcaaaagcgattcgatcgttaatagtggttcacgatcggatcttaatgcacgaatcctgaaaagcgtggtggatcaactggatatcgccaaaatccacctgctgggcaactcgatgggcggccatagttctgtggcgttcacccttaactggccggagcgcgtcggcaaactggtgctgatgggcggcggtacgggcggcatgagtttgtttacgccgatgccaaccgaaggtattaagcgactgaatcagctttatcgtcagccgactatcgaaaacctgaagctgatgatggatatcttcgttttcgataccagcgatttgaccgacgccctgtttgaagcgcgcctgaataatatgctgtcgcgccgcgatcacctggaaaacttcgttaagagcctggaagctaatccgaaacagttcccggattttggcccacgtctggcggaaatcaaagcgcaaaccctgattgtctgggggcgcaacgaccgctttgtgccgatggatgcgggtctgcgtctgctgtccggcattgccggttctgaactgcatatcttccgcgactgtggtcactgggcgcagtgggaacatgccgacgctttcaatcaattggtgctgaatttcctcgcacgcccttaaggaatggtcatgacgaagcatactcttgagcaactggcggcggatttacgccgcgccgcagagcagggcgaagcgattgcgccgctgcgcgatctgattggtatcgataacgctgaagcggcctacgccattcagcacataaatgtgcaatatgacgttgtgcaggggcgtcgcgtggtagggcgtaaagtgggcctgacgcatccgaaagtgcaacaacaactgggcgttgatcaaccggattttgggacgttatttgccgacatgtgttatggcgataacgaaatcattcctttttcccgtgttctgcaaccccgcattgaagcggagatcgcactggtgttgaaccgcgatttacccgcaactgatatcaccttcgacgaactgtataacgccattgaatgggtacttccggcgctggaagtggtggggagccgcattcgcgactggtcgattcagtttgtcgataccgtggcagataacgcttcctgcggggtgtatgtcatcggcggtccggcgcaacgtccggcggggttagacctgaaaaactgcgccatgaagatgacgcgtaataacgaagaggtttccagcgggcgcggcagcgaatgcctgggacatccgcttaatgccgccgtctggctggcacgcaaaatggccagtctgggtgaaccgctgcgcgccggagatatcattcttaccggggcattaggcccgatggtggcggtgaatgcgggcgatcgttttgaagcccatattgaaggcataggttcagttgctgcgacattttcaagcgcagccccaaaaggaagtctgtcatgagtaagcgtaaagtcgccattatcggttctggcaacattggcaccgatctgatgattaaaattttgcgtcacggtcagcatctggagatggcggtgatggtcggcattgatcctcagtccgacggtctggcgcgtgccagacgtatgggcgtcgccaccacccatgaaggggtgatcgggctgatgaacatgcctgaatttgctgatatcgacattgtatttgatgcgaccagcgcgggcgcgcatgtgaaaaacgatgccgctttacgcgaagcgaaaccggatattcgcttaattgacctgacgcctgctgccatcggcccttactgcgtgccggtggttaacctcgaggcgaacgtcgatcaactgaacgtcaacatggtcacctgcggcggccaggccaccattccaatggtggcggcagtttcacgcgtggcgcgtgttcattacgccgaaattatcgcttctatcgccagtaaatctgccggacctggcacgcgtgccaatatcgatgaatttacggaaaccacttcccgagccattgaagtggtgggcggcgcggcaaaagggaaggcgattattgtgcttaacccagcagagccaccgttgatgatgcgtgacacggtgtatgtattgagcgacgaagcttcacaagatgatatcgaagcctcaatcaatgaaatggctgaggcggtgcaggcttacgtaccgggttatcgcctgaaacagcgcgtgcagtttgaagttatcccgcaggataaaccggtcaatttaccgggcgtgggtcagttctccgggctgaaaacagcggtctggctggaagtcgaaggcgcagcgcattatctgcctgcctatgcgggcaacctcgacattatgacttccagtgcgctggcgacagcggaaaaaatggcccagtcactggcgcgcaaggcaggagaagcggcatgaacggtaaaaaactttatatctcggacgtcacgttgcgtgacggtatgcacgccattcgtcatcagtattcgctggaaaacgttcgccatattgccaaagcactggacgatgcccgcgtggattcgattgaagtggcccatggcgacggtttgcagggttccagctttaactatggtttcggcgcacatagcgaccttgaatggattgaagcagcggcggatgtggtgaagcacgccaaaatcgcgacgttgttgctgccaggaatcggcactattcacgatctgaaaaatgcctggcaggctggcgcgcgggtggttcgtgtggcaacgcactgtaccgaagctgatgtttccgcccagcatattcagtatgcccgcgagctcggaatggacaccgttggttttctgatgatgagccatatgaccacgccggagaatctcgcaaagcaggcaaagctgatggaaggctacggtgcgacctgtatttatgtggtggattctggcggtgcgatgaacatgagcgatatccgtgaccgtttccgcgccctgaaagcagagctgaaaccagaaacgcaaactggcatgcacgctcaccataacctgagtcttggcgtggcgaactctatcgcggcggtggaagagggctgcgaccgaatcgacgccagcctcgcgggaatgggcgcgggcgcaggtaacgcaccgctggaagtgtttattgccgccgcggataaactgggctggcagcatgggaccgatctctatgcgttaatggatgccgccgacgacctggtgcgtccgttgcaggatcgaccggtacgagtcgatcgcgaaacgctggcgctgggatacgctggtgtttactcgagcttcctgcgtcactgtgaaacggcggcggcgcgttatggcttaagtgcggtggatattctcgttgagctgggcaaacgccggatggttggcggccaggaggatatgatcgttgacgtggcgctggatctgcgcaacaacaaataatgatgactgccgagaacgtgcattttgtatgcccatcccagcacgactgccggatgcggcgtgaacgccttatccggcctacatttcgcccgtaggcagtcattaaatagttctgattacgcggctggcaatgtatcagtcgcgattcacctgcactcgcaatgaggttcatcttatgtcgactcgtaccccttcatcatcttcatcccgcctgatgctgaccatcgggctttgttttttggtcgctctgatggaagggctggatcttcaggcggctggcattgcggcgggtggcatcgcccaggctttcgcactcgataaaatgcaaatgggctggatatttagcgccggaatactcggtttgctacccggcgcgttggttggcgggatgctggcagaccgttatggtcgtaagcgtattttgattggctcagttgcgctgtttggtttgttctcactggcaacggcgattgcctgggatttcccctcactggtctttgcgcggctgatgaccggtgtcgggctgggggcggcgttgccgaatcttatcgctctgacgtctgaagccgcgggtccacgttttcgtgggacggcagtgagcctgatgtattgcggtgttcccattggcgcggcgctggcggcgacactgggtttcgcgggggcaaacttagcatggcaaacggtgttttgggtaggtggtgtggtgccgttgattctggtgccgctattaatgcgctggctgccggagtcagcggttttcgctggcgaaaaacaggctgcgccaccactgcgtgccttatttgcgccagaaacggcaaccgcgacgctgctgctgtggttgtgttatttcttcactctgctggtggtttatatgttgatcaactggctaccgctacttttggtggagcaaggattccagccatcgcaggcggcaggggtgatgtttgccctgcaaatgggggcggcaagcgggacgttaatgttgggcgcattgatggataagctgcgtccagtaaccatgtcgctactgatttatagcggcatgttagcttcgctgctggcgcttggaacggtgtcgtcatttaacggtatgttgctggcgggatttgtcgcggggttgtttgcgacaggtgggcaaagcgttttgtatgccctggcaccgttgttttacagttcgcagatccgcgcaacaggtgtgggaacagccgtggcggtagggcgtctgggggctatgagcggtccgttactggccgggaaaatgctggcattaggcactggcacggtcggcgtaatggccgcttctgcaccgggtattcttgttgctgggttggcggtgtttattttgatgagccggagatcaagaatgcagccgtgtgccgatgcctgacgcgccttattaagcaggggcgaaagggacttgcccccaatacacccacggcgtttacaggtatactcgctaaaaattattcagcgggtttggaaacaaagatggcaaaacttaccttacaagagcagttgctcaaagcaggattagtcaccagcaaaaaagcggcgaaggtcgagagaacggcgaaaaaatcgcgcgttcaggcgcgtgaagctcgggctgcggtagaagaaaataaaaaggcacagcttgagcgtgataaacagcttagcgaacagcaaaaacaagcggcgttggcgaaagaatataaagcccaggtgaagcagctcattgaaatgaaccgaatcaccattgccaatggcgatattggttttaacttcactgacggcaatctgattaagaagatttttgtcgataagctcacacaggcgcagttgattaatggtcgtctggcgattgcccgcttgttggtcgataacaatagcgaaggtgaatacaccattattcccgccagtgttgccgataaaattgctcagcgtgatgccagcagtattgtgttgcacagcgcgctcagtgccgaagagcaggatgaagacgatccgtatgccgacttcaaagtgcctgatgatttgatgtggtaaacatagataagtcgtgcgccatgcctgatgcgacgctttgcgcgtcttatcaggccttgtattatccctccagtgcagagaaaatcggccagttttctctgcctgcagtccgcatgccgtatcgggccttgggttctaacctgttgcgtagatttatgcagcggactgcctttctcccaaagtgataaaccggacagtatcatggaccggttttcccggtaatccgtatttgcaaggttggtttcactatggaacatgaacttcattatatcggtatcgacaccgctaaagagaaactggatgtcgatgtgttgcgtcctgatggtcgtcatcgcaccaaaaaattcgctaacaccactaaagggcacgatgagctggtgagctggctgaaaggtcacaagattgaccatgcgcatatctgcatcgaagcgaccggcacctatatggaacctgtcgctgagtgcctttacgatgctggctacatagtgtcagtcattaatcctgcgctgggtaaagctttcgctcagagtgaaggactgcgtaacaagactgataccgtggatgcgcgcatgctggcagagttctgtcgtcagaagcgccctgcagcctgggaagcgcctcacccgcttgaacgcgcgttgcgtgccctggtagtccgccaccaggcgctgacagatatgcacacgcaggaactgaatcgcactgaaacggcgcgggaagtccagagaccgagcattgatgctcaccttctgtggcttgaagcagagctgaagcgtcttgagaagcagataaaagacctgacagacgatgatccggatatgaaacaccgcaggaaactgctggaaagcatcccgggtatcggagagaaaacatctgcggtattgctggcttatatcggtctgaaggaccgcttcgcccatgccagacagttcgccgcttttgcgggtctgacaccacggcgttatgaatcaggtagcagtgtgagaggggcgagccggatgagtaaggccggacatgtgtcgcttcgcagggcgttgtatatgcccgcaatggtagccaccagtaagactgagtggggacgggcgttccgcgaccgtctggcggctaatggcaagaaaggaaaggtgattctcggcgcgatgatgcgcaagctggcacaggtggcgtatggagtgctgaagtcaggcgtgccgttcgatgcgtcacggcataatccggtagcggcgtaaaaatcgcggaagggatgaaaaaaacagcgcctgacggcgctgtgtctggcatgcctgcaatccgggaaaccggaccaggaaaaaacttgcaggccataacagtatctacggtttacgggcgaagtgtaggccggataaggcgttcacgccgcatccggcagtcgtgcactattatcaacgcatattcagtttattggcgtggtaggcaatatgctcgccaataaaactggagacaaaataatagctgtggtcgtaaccctcgtgataacggattaacgtcttgatattcatctcctggcagatcttttcaagatttggagtccgcagctgttccgcgtaaaaatcatcactcaacccctgatcaaccatgatttccgcaacgcgttgaccttgtgaaataagactcaccggatcgtaatccaaccaggcatctttattttcaccaagatatgcggcaaaggcttgctgtccccacggtgcttgcgatggggagacaatgggcgaaaacgccgagacgctgacatattcatctgggttacgtaacgccagcaccagcgcgcccagcccgcccatagaatgaccagagatagactttctggtcgttgccggaaaatgttgcatcactaaatccggcagctcgttgcggatatagtcatacattttgtaatgttcattccacggcgcttgcgttgcgttcaggtaaaacccggcaccttgcccgagatcgtaacggtcggcatctgcgacatgactgcctcgcggactggtgtccggcgcaacaacaataatgttgtgttcagccgcgtaacgctgcatccccgatttagtaatgaaattctgctcgttgcaggtcaggcccgaaagccagtacagcaccggcaatttttcattcgcggcttttggtgggagatagacgccgacattcatttcacatttcagtgattgggaataatgccgatacacattttgccagccgccaaagctggcatgtttttcaatgagttccatcagtcattatctcacggttaatcccccggacggctgcccagggagagtattaagaaccccgtctgaagtggacggggtatacctgcgggaaatcagtaacgaattacggttcgaatggatttgccttcatgcatcaggtcgaaggcgtcattaatttcatcaaggctcatggtatgcgtgacaaacggttccagatcgatatcacctttcatcgcatcttcaaccatacccggtaactgggaacgacctttcacgccgccaaacgcggaacctttccatacgcgaccagtgaccaactggaatggacgggtggagatttcctgaccagaacctgccaccccgatgatcaccgactgaccccagccgcggtgcgcactttccagcgccgcacgcatcacgttgacgttaccgatgcattcaaaggtatggtcgataccccatttgttgatatccagcaggacatctttaatcggtttgtcgtagtcattcgggttaatgcagtcggtagcaccgaagcgacgcgccagatcgaatttcttcgggttggtatcgatagcgataatccgtcccgctttcgcctgacgcgcgccctgaaccactgccagaccaatcgcgccaagaccaaacacggcaacagaatcacctggctggactttagctgtgttgtgcaccgcgccaataccggtggtcacgccacagcccagcaggcagacgtgttcatggtttgcttctggattaattttggccagagacacttccgcgaccacggtgtattcactgaatgttgagcatcccatgtagtgataaagcggctgcccgttgtaagaaaaacgggtggtgccgtctggcatcaagcctttaccctgggtttcgcgaaccgcaacacagaggttagttttgccagaacgacagaactcacactcgccgcactccgcggtgtaaagcgggatcacatggtcgccaggtttgacgctggttacgccttcaccgacttcaaccacaacgccggccccttcgtgaccgagaaccaccgggaatacaccttccgggtcatccccagagagggtaaatgcgtcggtatggcaaacgccggtatgggtgactttaatcagcacttcaccttttttcggtggtgcaacgtcaatttcaacgatttccagcggtttaccgggagcaaatgcaacggcagcacgtgatttcatctctcgctcttcctcaatatggtaatagattcagctatttaagataggctcgaaccagttcaatagtgtcgtcaacggattggctgacttcgcggctgtagcagtcatttcggtcaaacgtttcccggatatggctttcaagcacttctgccatcagcccattagccgcgccccgaacggcagcgatctgttggagtatggcacggcattcggcatcaccctccagcgaccgttccagagcatcaatctgccctcgaatacgacgaactcgagtaaggacctttttcttctcttccggagtactgggcatttcgcacctcattatctgcacgcaatatactataggggggtatgctatatgtcaatgcatacccccctatagtatataacactggagaataaaatttatccggtgaatgtggtcggaaaacaaagaggaaaggggggggctaatcggcagggaaggccgccccggatagcgggcggcagaaggaatcagaatttccaggtcagatgggctgcaagttgcagaccgttataatcatcggttggggtgtcgtaccacactttacctgccgtcagcccgagattaagttgctcagtcagcggttgaatacgttgcagactgacgctcttcatgctgccgtagcgtgtttctggcgtccagtcataggtgtaagcgcctgttccgcggcttagccatagttgcgtataaccagtgccgcgcgggtcattcagacgcacggaaatcatattgctataactaccacctgcatcgctggagtcataatgggtatagcggtagctggtgatcaccgggccagtatagagtgatacgccgccttgccaggcatcgacttcgacatcatcgtaatatttagtgtagcgataaccggtcgtgaaaagcgtttttggcaacagggccaggttaatatcctgacgaaaatcctggcgggcaaagaccggcgtattatccgcaaaggcaatacccgttcgggttgtcagccagttattccatttataccagaccgcaccctgaccgcgagtggcattgaaatgttcagtttcataatcacgacgcccctgggaaagattaaaaagcagcgttgcgttttcaactttcgccaccagttcagcatacgctaaattacggttgccatgatcgccagaataatcggtaaaatcgtagcccgcggtaatggaagttaacccggcataagcgggcaatgcgctaaaaatggccgccgctaataacgtccgttttatcattttaatctcctgtacggataagttcttgtcggagtgaataagttccggcaggtaaattacgttctacaatcacgcgcgggccaagttgcgtgttcggggaaataattcgcccaggcaaaattataacttgtacgccaaggcgtgaacgctgcccgatataacaacctaatttatcgcatccggtagcgataattccctctggagttcgaacagacacaggctgttcatccagacgatgattactggtacgtacttgtgcgcccaaatatgcctggtttgcaactaccgagtcggcaataaaacattgcggaccaatcgttgcttccgcttcaataaccgcatttttaatttcggtggcaaaaccaatttttacaccattgctgattattgtgccaggacgaataaacgcataattacctatcaggcagtttgcgccaatcactaccggaccctgaataacggcaccatgacaaatacgggtattcgcgccgataacaacttcacctgcagtttcatcaataattacctggtctgcaatctgaatatttttctctttaacattaagcttcagatagtttttcagttcctgtgacagaaggttgggaataagcggttgacgcttccaccagtgcggaatagcgggtgggtttgtcgcgctgaggttcgcgtccagtaaaaaaggcaataagtccataaataatccagatggcataagctaataatacatacacaacggaaagcggcgctaaaggcaccaacaaccagcaacgatgaaaccaggcgctaaaagcaccaataacacaaactacgccgatccagataagcggaaacattgccaacaccacaccatgcggcccggtggtgatgaattcattaaaccaggtagtgagataaatcccaacgccataaagcacaaccaacagcataggaaatatactgaagataccgaagcggctaaataaaagtcttttatgcaggcgcatacagaccgcgtatcccacaatccaacgccgccagcgacgccactcctcacgcgggctgttgcattcctgtgggtatacgatgcagcgattcgcctgccgaatacggtagccgtttgccactaatgtccaggtgagatcaaggtcttcgactttagtacgatccgagaaaccgaacttacgcaatacatcagtacggaacatcccgcaggcaccgctgataataaacggtgcgccgcccaggagctgctgtagcgtgcgcttcataacaatcatcggcaactttacggtcgcgcggatgtgcggtaacagccccgcgcctttcaacgcagtagagggaatgccgcctacggcatcagcaccgcgctcaatttctgccagcatatagcccattccgtcttgatcgggcggaacataggtgtcggcatcacttaaaaaaacctggtcgcaggtggcataattgaggccattcatcagcgcaccacctttaccggtatttttttgcgtgacggcaacaaagcggtcgccccatttgcgtttgacttccgccatgaccgcttcggtattgtccgtggagccgtcgttaacgcaaattacccggcaaaaataagggttacgcagtagattatccagtgactgcgccagacacgggccttcgttatacgcaggtataatggcgtcaatacagcctttcttttgactgggtttacgtcttagcgtacttaaaaaccatagcaacattgctatggacatacagataaatatccaggttttcatgcaatttgctcaaagaatcattttatgaattacaaagccttcacccaattcgctattgacctgttgcccgcgaaattgtgcaactgcacgcaggcgatcatgacgcatataatcacgtcgttcctggcttttatgtttttttaatgcagcaagtttgactgtgaaatattcttctttaacggattcaaaaacctgaggcataaatgaaagccaggtacttggggtttcgtagccgagaatttgtggaatagtgcggcaggcaaccattgaagcttgataaacagcgagatgatcctgatggcggtcggcatcatgcatggtatatacccgcatgatttcaacatcagaaggaatttgatttttaatgatgtcttccagagcggaaatcatatcattgagctgtaaatgagcgcgggtgtcagcaaaattaagatgaatagtttggtggcaccctaatatctttagggcgttgcgcgattcttcatggcgatcgattattccatctgtaccagagttgccggtagtcatcaccacggctgcgatataaattcctttttgcgcaagacgagcaagcgatgcgccacagcctaattctatatcgtcaggatgtgcgccaatagcaaggataccctttcttttatttgccgaagaaaggagggctgaatctaaaaccttatccacttaatgacactccattttatttattatactacaagcacaacgatgcactcagagacgtaatctctggcgcagccagatgttaatttataaatgttaaatgttgctaataactgaaaagcaagggctttcagacccggaggttcgactgggtaatgtttttatgcaattcatatgttaagtgtttgtatgtttggtatgtatagttattttgttttatacattgtatttagatgtgatttagtttgtcaattaattgcatttaaaaaatatgttctgtgaacaagtattgtttatatacattatgtgaatgtaatatgcgagtgattgagaatgatacagtgatatatacaatgcgaatataatagttttattatatgtattgatattgatagaaataatgaagtaataaatctcgtaatgtggttgtttatgcatcactaaaatgaagtgtagtaattttcccaattgttagaacggagtaattgcatatttaatctttcctttgccgtttttttgctaagaataaaatcatctgtgcgataacgactaattcttttaatgaatgtttttattcctgaatactgctcacataacaagacaggggagcagacaatcatggcaatttcatcgcgtaacacacttcttgccgcactggcattcatcgcttttcaggcacaggcggtgaacgtcaccgtggcgtatcaaacctcagccgaaccggcgaaagtggctcaggccgacaacacctttgctaaagaaagcggagcaaccgtggactggcgtaagtttgacagcggagccagcatcgtgcgggcgctggcttctggcgacgtgcaaatcggcaacctcggttccagcccattagcggttgcagccagccaacaggtgccgattgaagtcttcttgctggcgtcaaaactgggtaactccgaagcgctggtggtaaagaaaactatcagcaaacccgaagatttgattggcaaacgcattgccgtaccgtttatctccaccacccactacagcctgctggcggcgctgaaacactgggggattaaacccgggcaagtggagattgtgaacctgcagccgcccgcgattatcgccgcatggcagcggggtgatattgatggtgcttatgtctgggcaccggcggttaacgccctggaaaaagacggcaaggtgttgaccgattctgaacaggtcgggcagtggggtgcgccaacgctggacgtctgggtggtgcgcaaagattttgccgagaaacatcctgaggtcgtgaaagcgttcgctaaaagcgccatcgatgctcagcaaccgtacattgctaacccagacgcgtggctgaaacagccggaaaacatcagcaaactggcgcgtttaagcggcgtgccggaaggtgacgttccggggctggtgaaggggaatacctatctgacgccgcagcaacaaacggtagaactgaccggaccggtgaacaaagcgatcatcgacaccgcgcagtttttgaaagagcagggcaaggtcccggctgtagcgaatgattacagccagtacgttacctcgcgcttcgtgcaataaaaggaggcgcagatgctgcaaatctctcatctttacgccgattatggcggcaaaccggcactggaagatatcaacctgacgctggaaagcggcgagctactggtggtgctggggccgtccggctgcggtaaaaccacgttgctgaatctgattgccggttttgtgccttatcagcatggcagcattcaactggcgggtaagcgtattgagggaccgggagcagagcgcggggtggtttttcagaatgaagggctactaccgtggcgcaatgtacaggacaacgtggcgttcggcctgcaattggcaggtatagagaaaatgcagcgactggaaatcgtgcaccagatgctgaaaaaagtggggctggaaggcgcagaaaaacgctatatctggcagctttccggtggtcaacgtcagcgggtggggattgcccgcgcgctggcggcgaatccccagctgttattactcgacgaaccgtttggtgcgctggacgccttcacccgcgaccagatgcaaactctgctgctgaaactctggcaggagacgggcaagcaggtgctgttgattacccacgatatagaagaagcggtgtttatggcgactgaactggttctgctttcatccggccctggccgtgtgctggagcggctgccgctcaactttgctcgccgctttgttgcgggagagtcgagccgcagcatcaagtccgatccacaattcatcgccatgcgcgaatatgttttaagccgcgtatttgagcaacgggaggcgttctcatgagtgtgctcattaatgaaaaactgcattcgcggcggctgaaatggcgctggccgctctcgcgtcaggtgaccttaagcattggcacgttagcggttttactcactgtatggtggacggtggcggcgctgcaactgattagcccgctgtttttgccgccgtcgcaacaagtactggcaaaactgctcaccattgccggaccgcagggatttatggacgccacgctgtggcagcatctggcagccagcctgacgcgcattgtgctggcgctactcgcggcggtggtgatcggtattccggtcgggatcgccatggggctaagcccgacggtgcgcggcattctggatccggtaatcgaactttatcgtcccgtgccgccgctggcttatttgccgctgatggtgatctggtttggtattggtgaaacctcgaagatcttactgatctatttagcgatttttgcaccggtggcgatgtcggcgctggcgggggtgaaaagcgcgcagcaggttcgcattcgtgccgcccagtcgctgggtgccagccgtgcgcaggtgctgtggtttgtcattttgcccggcgcgctgccggaaatcctcaccggattacgcattggtctgggtgtgggctggtctacgctggtagcggcggagctgattgccgcgacgcgcggtttaggatttatggttcagtcagcgggtgaatttctcgcgactgacgtggtgctggcgggaatcgcggtgattgcgattatcgcctttcttttagaactaggtttgcgcgcgttacagcgccgtctgacgccctggcatggagaagtacaatgagtgaacgtctgagcattaccccgctggggccgtatatcggcgcacaaatttcgggtgccgacctgacgcgcccgttaagcgataatcagtttgaacagctttaccatgcggtgctgcgccatcaggtggtgtttctgcgcgatcaaactattacgccgcagcagcaacgcgcgctggcccagcgttttggcgaactgcatattcaccctgtttaccctcatgccgaaggggttgacgagatcatcgtgctggatacccataacgataatccgccggataacgacaactggcataccgatgtgacatttattgaaacgccacccgcaggggcgattctggcagctaaagagttaccttcgaccggcggtgatacgctctggaccagcggtattgcggcctatgaggcgctctctgttcccttccgccagctgctgagcgggctgcgtgcggagcatgatttccgtaaatcgttcccggaatacaaataccgcaaaaccgaggaggaacatcaacgctggcgcgaggcggtcgcgaaaaatcctccgttgctacatccggtggtgcgaacgcatccggtgagcggtaaacaggcgctgtttgtgaatgaaggctttactacgcgaattgtcgatgtcagcgagaaagagagcgaagccttgttaggctttttattcgcccatatcactaaaccggagtttcaggtgcgttggcgctggcaaccgaatgatattgcgatttgggataaccgcgtgactcagcactatgccaatgccgattacctgccacagcggcggattatgcatcgggcgacgatccttggggataaaccgttttatcgggcggggtgatacgagtgcggacggttccctcgcccccttggggagagggttagggtgagggggcgttcaccgtactttcaacaggttaactccccctttctgagaggaaaaaaattaacgcagaatcttcttctcagccaaatccagcgcaaagtagctgaaaatcagatccgcacccgcacgcttaattgaacctaagctttcgagcacgactttctcttcatctatagcacccgccagcgcggcgaacttaatcatcgcgtactcaccgctcacctgatacgcgccaatcggcaattcagtacgttcacgcagctcacgcacgatgtcgaggtacgctccagcaggtttaaccatcaggcagtctgcgccctgggcttcatccagcagtgactcacgaatcgcctcgcgacggttcattgggttcatctgatagcttttgcggtcgccttttaatgcgcttccggcagcttcacggaacgggccataaaaggaagaggcgaacttggtcgaatacgacataatcgccgtatctttaaagcctgcagcgtccagcgcctgacgaatcgcctgtacctggccgtccatcgcggcggaaggggcgatgaagtctgcgcctgcagcagctgcaaccacggcttgcttgcctaaattttccagagtcgcgtcgttgtcgacgccatgctcgcacagcacaccgcagtgaccgtgagaagtgtattcacagaaacaagtgtctgacatgacgatcatttctggcacagtctgcttgcagatgcgcgacatacgcgccaccagtccatcttcccgccaggcgtcgctgccggtttcatcggtatggtgagagatgccaaaagtcattacggaacggataccggcgttggcgatgcgttcaatttcgcgtgccagatgtttctctggaatgcgcatcacgcctggcatggcttcaacggctttgtagtcgtcaatttcttcttcaacaaagatcggcaacaccaggtcgttaaggctaagtgttgtctcttcaaacatagcgcgcagcgcaggagatttgcgcaggcgacgagggcgttggattaagtctgtcatggtctgcctgatgtttgtggaattaaggtgcacagtatacctgaagcggggcaggagtgttttacgaaagttgtcgtgatgttgacaagaagagaatgaaagagagaccaggacatctttgtaatagaaatagcaataatttcatattcactgaaaatatttttaatctttatttatagctcttggttattattttttggcgtttggttgtgctgctataaattgaataattcaaactttgttgtatattgataagatatttatctggtttgtgtttttgatatttataacgcgtatgtatcaaaaataacattatctgcaacatgttgaaatatcgcccttttatcaatttgatgcgtgtttttctccataggttatatatgtccacattcggacttaggggaaagaataattgaaccattcgtctgtaacgcagcataatcattagcgcgaaacataatatgttttctatgcattgataattgatggatcaacttattacgtccctgaggagggatgacaaatgcactcctggaaaaagaaacttgtagtatcacaattagcattggcttgcactctggctatcacctctcaggctaatgcaactacttataatacattcgggtatcacgatgacgcagtcactctattcaattggggcgacaatactaaaactgatcacgactatttgacgtatggtggctatgtatacgaccatgcggctgatggttattttgatactgtatttagtggcgataccgttaatggtgtaatttctacttattatctgaatcacgactatggaacagataccgctaatactctgaatattacgaactcaaatattcacggtatgattacttccgatcagatcggatacggtgattacgtctggaccaacggtagcgattatactggtcatgattgggtagatggcgatattttcactctgaacatcgcgaactcaacaattgacgatgattttgatgcattctacttcaatgatacttatctggatgcagacggtaaaacgtctaaaacagattatgatcgtctggtaacagctgctcttggcaccgctgtaactctggatgttgaaagtaacatcaatatcagcaacaactcccatgttgcaggtattactctggttcaaaacgatttaggtaatgcgacttacaatactgaaggtcatcagtgggacaacaatatcgttgttaataattccactgtaacttcaggttcgctctcagaagacgaacaatcagatcgtggtcattttggcaactctgttgagccaagcgactatggtaatggtgcatcaggtgctgatgatgttgcattagccttcatagatgatgacacttctgattatcgtatggtcaacaacgttacattcaacaattctcagttgcttggcgacgttgtatttgacagtacctggaacgctaactttgacgcgacgggtcacctgattgacaactctaccactgcttacactcatggcggttgggctactgacgatcagaacgtcgatcacctgaacctgactctgaacaacaccaaatgggttggttcagcgaatattgattatgacgttgttgttgctgacgaagccttctacgacgttgcgccaaacagcctgaacccgtacgcttcttactctgaagatggctggaatcgtgttgataacgctaacgcattccagagtggcgtattcgatgttgttctgaacaatggttctgattgggaaaccacgaaagattctctgatcgataccctggctatcaacagcggttctcaggttaacgtgagtgcagattcttccctgacttccgacaccatcactctgaacggtagttcttcaatggaagttaacggtgaagttaacactgatcacctgatcattgataccttctctactgttaacttcggtgaagatactgcttcagcttggacatctgcaccgctgtacgccaacaccattaccgttactaacggtggtgtgctggatgtaaacaccaacatgaatgaatcgccacggataatctagacacttccgagccgttgataatactggttttcatattctgtcggtgacatctgttcgctagaaccatgccgacgcttactgttataaaacatttcgatgtaatcaaaaatatcactgcgggcttcttcccgcgttccgtagatctttttctttatccgttcacgtttcaacaactggaaaaaactttctgcaaccgcattatcatggcagttaccgcgacggctcatgctaccctccaggccgtgtgatttcaggaacgactgccactcatggcttgtgtactgactgccctgatccgaatgaaccagcacctgtttttcgggattacgccgccatacagccatcagcagtgcgttcaggacaatgtcctttgtcatccgggattgcatggaccagccgataattttgcgtgagaacagatcaacaacaacggcaagatacagccagccttcgtgggtcctgatgtaggttatgtccgttacccaacgctcatcaggagcatccggattgaactgtcgctggagcctgttgggtgacacgatactggcctcgcctttacgtgcccgcgggcttcggtatccgacctgagcctttattccgacacgtttcatcagtctccagactctgtttactccgcactgttgcccgctgtcacgcaaatccagatggattttgcgataaccatagacgcatcccgattccagccagaactgtttaatctgtcctgtcagtctcaggtctgcctgatggcgttgtgaatgcggctgctgaagccaggcgtaaaaaccactgggatgaacatccagcacccgacagagcaggcgaacaggccagcaacaggagttgtcacggataaaggcgtacctcagtcggacagctttgcgaagtacgccgcggctttttttaatatgtcccgttcgtcggtaacccgtttcagctctttctggagacggcggatctcggcctgagcatctgactgttctttattagtggaagaatccggaccgtacttctttatccaggcataaaggctgtgggtggtgatatcgagacgtgttgcaacgctggcaacagaataaccgcgatcaacaacctgtttgactgcttcagttttaaactcttcgggataacgcttaccgctcatgggcacctctctttaagccatcttaaatgactctgaggtgtctgttaaacccgtggcgattcagaatgacatctccagcgtatttgcaactgatactctggaactgaccagtggcaacgttaaagataacaacggtaatgtttacgcaggtgtgtttgacattcatagtaatgactacatcctgaatgcagacctcgtcaacgatcgtaccaacgacaccagcaaagctaactatggttatggtgttattgcgatgaactctgatggtcacttgaccgttaatggtaacaacgacattaataatggcgacgaagttgacaacagctctgttgacaacgttgtagctgcaaccggtaactacaaagttcgtatcgacaactccactggtgctggcgcgattgctgattacgcaggtaagcagctcatctatatcgatgataccaaaaccaacgcgaccttctctgctgctaacaaagctgacctgggtgcatacacctatcaggctgaacagcgcggtaacaccgttgttctgcaacagatggagctgaccgactacgctaacatggcgctgagcatcccttctgcgaacaccaatatctggaacctggaacaagacaccgttggtactcgtctgaccaactctcgtcatggcctggctgataacggcggcgcatgggtaagctacttcggtggtaacttcaacggcgacaacggcaccatcaactatgatcaggatgttaacggcatcatggtcggtgttgataccaaaattgacggtaacaacgctaagtggatcgtcggtgcggctgcaggcttcgctaaaggtgacatgaatgaccgttctggtcaggtagatcaagacagccagactgcctacatctactcttctgctcacttcgcgaacaacgtctttgttgatggtagcttgagctactctcacttcaacaacgacctgtctgcaaccatgagcaacggtacttacgttgacggtagcaccaactccgacgcttggggcttcggcttgaaagccggttacgacttcaaactgggtgatgctggttatgtgactccttacggcagcatttctggtctgttccagtctggtgatgactaccagctgagcaacgacatgaaagttgacggtcagtcttacgacagcatgcgttatgaactgggtgtagatgcaggttataccttcacctacagcgaagaccaggctctgactccgtacttcaaactggcttacgtctacgacgactctaacaacgataacgatgtgaacggtgattccatcgataacggtactgaagggtctgcggtacgtgttggtctgggtactcagttcagcttcaccaagaacttcagcgcctataccgatgctaactacctcggtggtggtgacgtagatcaagattggtccgcgaacgtgggtgttaaatatacctggtaatattcttcactccgaagaaattctggtaatttaatctaaataatgcccgtcaaggatttgacgggcattactgcaaaggacgcgcaaatgttatctgtagttaaacctcttcaggaatttggtaagctcgataaatgtttgtccagatacggtacgcgcttcgagtttaataatgaaaagcaagttatattttccagtgatgtcaataacgaagatactttcgttattttagagggcgttatctctctgcgtagagaagaaaacgtacttatcggtattacccaggctccttatattatggggctggctgatggtttaatgaaaaacgatataccatacaaattaatatcagaaggaaattgtacgggatatcatctaccagccaaacaaaccattacgcttattgaacaaaatcaactctggcgagacgctttttactggttagcctggcaaaatagaattctggaattacgcgacgtgcagctcattgggcataattcctacgaacaaatccgcgcaacattattatcaatgattgactggaatgaagaattgcgatcacgtattggtgtgatgaattatatccatcaacgtacacgcatatcgcgttctgtcgtcgcagaagttctcgctgctttgcgtaaaggcggctatatcgaaatgaataaaggcaaactggtcgctatcaaccgtttgccttcagagtattaatcaggatgcggggataaccaacggtttattcccgcttagctcggtcaccagatcattgatgccatcgctcatatttttaaagcgcgtcaacggcgaacgagtgaccaccacaaacgcgccaatattcttctgcgggatcatcgccatataggtaatgaaaccgccaccaccgcctgtcttctgaataatccccggacgaccctctttcggggccatatatacccagcctaaaccaagcgcatccgctttgccggggacatccatgccaatcactttcgtaaactgcgcgcgctgataaatcaacgtctgcatgcgatctgcctggttactgcgctgataaaaatcagatgacaaatactgctgcatccagcgcatcatatcgccaggcgtggaatagacgccgccgctgccaattgccgccagcgtgttattgcacggactggcaccgcgctcagcaaccattaaacggcggcactgatccggtgagggggtgtaggtggtgtctttcatccccaatggacgggtaatctgctcttcaaacaactgggtataaggcttgccggacgcattcgccagtgcatctgccagcaggtcgaacgcaaggttagagtacgccgcctgactgcctggcgcggctttcagcttcgccgtagaaaggtatttccagcgttgctcgcgcgttggccagacaaacaccggacgatgtgccgcgccaccgggctgttcacggggcagggcgctggtatgggttgccagattcactagggtaatgggcgtcccattgtaggttggcacgcgtgcgcctggcggagcatatttacttagcggatcgtttaacttcacggtcccctggtcgagcaatttcaccagcatttcactggtcattagcttggtgagggaagcaatacgcacgaccgaatccagctgcgggcgaacgttattaccaggtcgcgtttcgccataactgcgaaagacgcgctggttaccgtcgataacaaccagcgccatccccgtggcaccgctgccgtaaaaaatatgatcggcataacgatcgacaatatcagaggcaaactccggttcagtgatcggctgcgccgcatggacggaggtcaatgacgccgcacacagcacggcagaaaaaagcagactacgtttcaacggtggtgtccatagattgaatgaaggtaactgagcgtatttatactactcattgatggattgcaaagggcgaattagtgcaataatagtgttaaaaacgtaacggcgcgtaaacacgatctttttcctgctcaccaatgcctgcatttgtgatcctgcgcgtgttaatccgcttatgtaaacaatctttggtttgtgaaatccgtcgaaacaattcttatggtcaggctggcgaactaagcgccttgctatgggtcacaatgggcggtttcatttggctgacgctttgtagcggtcatgcggttaatacacagcagttgttaaaacgataagaagttagcaggagtgcatatgtttaagtcttttttcccaaagccgggagcgttttttctctcggcctttgtttgggcattgattgccgttatcttctggcaagccggtgggggagagtgggtggcgcgtatcactggcgcttccgggcagatcccgattagcgccgcgcgtttctggtcgttggatttcctgattttttacgcttactacattgtttgcgtaggactttttgcatttttctggtttatctacagcccgcaccgttggcaatactggtcaatactcggtactgcactgatcatcttcgtcacctggtttttggtggaagtcggggtcgccgtcaacgcctggtatgcaccgttctatgatctgattcaaaccgcgctaagttcgccgcataaagtcactatcgaacaattttaccgcgaagtgggcgtctttctggggattgcgctgatcgctgtggtgatcagtgtgctgaacaacttctttgtcagtcactacgtgttccgctggcgtacggcgatgaacgaatattacatggcgaactggcaacaactgcgtcatatcgaaggggccgcacagcgtgtgcaggaagacaccatgcgttttgcttcaacgctggagaatatgggcgtcagttttatcaacgccatcatgacgttgatcgccttcctgccggtgctggtaacgctctccacgcatgtgccggagctgccgattatcgggcacattccgtatggtctggtgattgccgctatcgtctggtcgctgatggggaccggattgctggcagtggtagggatcaaactgccggggctggagtttaaaaaccagcgagtagaggccgcctaccgtaaagagctggtttatggtgaagacgatgccacgcgtgcgacgccgcctacggtacgcgagctgtttagcgccgtgcggaaaaactatttccgcctctattttcactatatgtatttcaacatcgcccgcattctctatttgcaggtcgataacgttttcggtttgttcttgctgtttccgtcaattgttgccggtacgattacgctcggcctgatgacgcagattaccaacgtttttggtcaggttcgcggtgctttccagtacctgattaactcatggaccacactggttgagttgatgtctatctacaaacgtctgcgcagctttgaacatgaactggatggtgacaaaattcaggaagtaacccataccttgagctaaaaaggagaagtaatgtcgcgcgtcaatcctctatcttcgctgtcattgttggcggttctggttttagcggggtgtagtagtcaggctccgcaaccgttgaaaaagggcgaaaaagcgatagatgtggcgagcgtcgtgcggcagaagatgcctgcgagcgtgaaagaccgcgatgcctgggcgaaagatctcgccaccacctttgaaagtcaggggctggcaccgacgctggaaaacgtctgctcggtgctggcggtggcgcagcaggagtcaaattatcaggcagatccggccgttccgggcttaagcaagatcgcctggcaagagattgaccgtcgtgctgaacggatgcacattcctgcttttctggttcataccgcgctaaaaatcaaatcgccaaacggcaaaagttatagcgaacggttagattcggtgcgtacagaaaagcaattgagcgcgatttttgacgatctgatcagcatggtaccaatggggcagacgctgtttggttcgcttaatcctgtgcgcaccggtgggccgatgcaggtcagcattgcttttgccgaacagcataccaaagggtatccgtggaaaatggacggtacagttcgtcaggaagtcttcagtcgccgcggcgggttgtggtttggtacttaccatttactgaattatcccgccagctatagcgcaccgatataccgctttgctgattttaacgctggctggtacgccagccgtaatgccgcgtttcagaacgcagtcagtaaggccagcggcgtgaagctggcactggacggtgatttaattcgttacgacagtaaagaacccgggaaaaccgaactggcaacgcgcaaactggcgggaaaactggggatgagcgacagcgaaattcgccgtcagttagagaaaggtgacagcttctcttttgaggagacggcgctgtacaagaaagtttatcaacttgccgaagcgaaaacgggtaaatcactaccccgcgaaatgttgcctggcattcaactggaaagcccgaaaatcacccgcaacctgactacggcctggtttgcgaagcgcgtagacgaacggcgcgcgcgttgtatgaaacagtgatcaaacaggaatgtcatgccagataaggcgttttaggccgtatctggcaacgtaaatcttactggcggcgatgtcgccagtgcagccatagcgccaccactgcaaaaatgaggcagcctactaaaaacgggatcagcccgaaaatggtgccgacacctaaaccaatttccacccgtgggcgacctgtttcctggacctgcattaaacgctcatagacgccgggcgcatgcactaacaggttcagcaattgcgccccagcccaaaagcaaaacagcacaaacaacgcataggcaatgttgccaggcgttgaagaggcattgcgatattttccgctaaacagcgattttgacagggtgaaatcagccataaaaacctccggaagtcatctgcttctcttctggtgtgataccagcggcttatggcaagtctgacaggtcatttagattgtcaatatcagaatcatggtaaattgatgttgggaatattcccgaagcgtgaatcttcgttgtgagtcacaaaatggcaaccttaagttaaatttattaacaattacgaaaatgttgtctacaccacagacggttgttacagaatatgcaaggatgttgtttttcgttaacggagctgccatgaatctgcctgtaaaaatccgccgtgactggcactactatgcgttcgccattggccttatattcattcttaatggcgtggtggggttactgggatttgaagcaaaaggttggcagacctatgccgtcggtctggtgacgtgggtgattagtttctggctggcggggttgattattcgtcgtcgcgatgaagaaactgaaaacgcccaataagaatattatcgggcgttaaaatattacattgtggttttcaatgcgttatccgcagcgtgacgctccagcgccagctcaatcaaacgtgtgatcagatcggtgtaacccagaccgctggcttgccacagcttcggatacatactgatgttggtgaagccaggcagtgtgttgatctcgttgatcaccacttcgttctctggggttaaaaacacgtctacacgcgccatgcctgcgcatcccaacgtctgataagcctgaacggcaatcgcccggatcttatcgttgatctctggtgcaatggctgccggaactaccactttcgcgccatcttcgtcaatgtacttggtgtcgtaggcatagaaatcgctggtgagtacgatctcgccacaggtgctggcttgcggattgtcgttgcccagaactgcgcattcgatctcacgacctttgatcccttgctcaacgatcactttatgatcgaactcgaacgccagatcgacggcaattgcgtactgttcttcactggttactttgctgacaccaacagaagagccctgattagccggttttacaaacagtggtaaccccagtttagactccacttcggcaaaactgatgttgtgacgattagcgcgcgtcagggtaataaatggcgcaatgttcagcccggcatcgcgtagcagacgtttggtgacatctttatccatacaggctgctgaagccagaacatcagaacctacaaacggtaaattggcgacccgcagcattccctgcaaggaaccatcttcgcccagcgtaccgtggacaatcgggaaaatgacatccaccgtcggcaacggctgaccgttttgcgcgtcgataagctgatgctcatgtttacctggcacctgcgcaaggctggtcgccgaagggcgcaacgcaatatgggcaggatcgtctgcatttagcagataattgctggcatcgctgacgtgccattgcccttgtttatcaatgcccagcagcacaacgtcgaagcgacttttatcaatggcatcgacaatgttttttgccgattgcagagacacttcatgttccgctgatttaccaccaaaaacgattcctacccgcagtttttccatcttaaaaacctatcccgtctaacacaaagtgcatacattaccacgacaaaacgggggattcgcggccttctgaaagattgttgcaatcttctgctgacaaagcgtgcaacgtactggtgaagaaagtgcgttatctcaaagatgtgcgcaagatcacaaaaatgatgaacgggaagctaatttattcctggcttaaatggccatgcggtgagtttttttctcttaattataagttaacgaagagaatatatttcataacttttatttataataaaggttgataattaaaagcctatattttgtgtgggtaattatttaaataagagaaacgtttcgctggtaatcaaacaaaaaatatttgcgcaaagtatttcctttgtcataaaaataatacttccagacactatgaagttgtgaaacataatgttaacttctccatactttggataaggaaatacagacatgaaaaatctcattgctgagttgttatttaagcttgcccaaaaagaagaagagtcgaaagaactgtgtgcgcaggtagaagctttggagattatcgtcactgcaatgcttcgcaatatggcgcaaaatgaccaacagcggttgattgatcaggtagagggggcgctgtacgaggtaaagcccgatgccagcattcctgacgacgatacggagctgctgcgcgattacgtaaagaagttattgaagcatcctcgtcagtaaaaagttaatcttttcaacagctgtcataaagttgtcacggccgagacttatagtcgctttgtttttattttttaatgtatttgtacatggagaaaataaagtgaaacaaagcactattgcactggcactcttaccgttactgtttacccctgtgacaaaagcccggacaccagaaatgcctgttctggaaaaccgggctgctcagggcgatattactgcacccggcggtgctcgccgcttaacgggtgatcataccgccgctctgcgtgattctcttagcgataaacctgcaaaaaatattattttgctgattggcgatgggatgggggattcggaaattactgccgcacgtaattatgccgaaggtgcgggcggcttttttaaaggtatcgatgccttaccgcttaccgggcaatacactcactatgcgctgaataaaaaaactggcaaaccggactacgtcaccgactcggctgcatcagcaaccgcctggtcaaccggtgtcaaaacctataacggcgcgctgggcgtcgatattcacgaaaaagatcacccaacgattctggaaatggcaaaagccgcaggtctggcgaccggtaacgtttctaccgcagagttgcaggatgccacgcccgctgcgctggtggcacatgtgacttcgcgcaaatgctacggtccgagcgcgaccagtgaaaaatgtccgggtaacgctctggaaaaaggcggaaaaggatcgattaccgaacagctgcttaacgctcgtgccgacgttacgcttggcggcggcgcaaaaacctttgctgaaacggcaaccgctggtgaatggcagggaaaaacgctgcgtgaacaggcacaggcgcgtggttatcagttggtgaacgatgctgcctcactgaattcggtgacggaagcgaatcagcaaaaacccctgcttggcctgtttgctgacggcaatatgccagtgcgctggctagggccgaaagcaacgtaccacggcaatatcgataagcccgcagtcacctgtacgcctaatccgcaacgtaatgacagtgtaccaaccctggcacagatgaccgacaaagccattgaattgttgagtaaaaatgagaaaggatttttcctgcaagttgaaggtgcgtcaatcgataaacaggatcacgctgcgaatccttgtgggcaaattggcgagacggtcgatctcgatgaagccgtacaacgggcgctggaattcgctaaaaaggagggtaacacgctggtcatagtcaccgctgatcacgcccacgccagccaggttgttgcgccggataccaaagcgccgggcctcactcaggcgctaaatactaaagatggcgcagtgatggtgatgagttacgggaactctgaagaggattcacaagaacataccggcagtcagttgcgtattgcggcgtatggcccgcatgccgccaatgttgttggactgaccgaccagaccgatctcttctacaccatgaaagccgctctggggctgaaataaaaccgcgcccggcagtgaattttcgctgccgggtggtttttttgctgttagcaaccagacttaatggcagatcacgggcgcaaacgctcatggttaaaacatgaagagggatggtgctatgaaaataacattactggttaccttgctttttggtctggtttttttaaccaccgtcggcgctgccgagaaaaccttaaccccacaacaacagcgtatgacctcctgtaatcagcaggcgacggcgcaggcgttgaaaggggatgctcgtaagacctacatgagtgattgcctgaagaacagcaagtctgcgcctggtgaaaaaagtttgacgccacagcagcaaaagatgcgcgaatgtaataatcaagcaacgcaacaatctctgaaaggtgatgatcgtaataagtttatgagtgcctgcctcaagaaagccgcctgatacctgatagtgctaacgggtgagctacgaaagtggctcacccgaaatttcatacttctgcctttagccccgtctctataatttgggaaaattgtttctgaatgttcccaaaaataatgaatgatgaaaactttttcaaaaaagcggcggcgcatggggaggaacctcctttaactcctcaaaacgaacatcagcggtccgggctgcgcttcgcccgtcgcgtcagactaccccgtgcggttggcctggctggcatgttcttaccgattgcttcaacgctggtttcgcacccgccgccgggctggtggtggctggtgttggtcggctgggcgttcgtctggccgcatttagcctggcagatagcgagcagggccgtcgatccgcttagccgggaaatttacaacttaaaaaccgatgcagtattagcgggaatgtgggtaggcgtaatgggcgtaaacgtgctgccttccaccgctatgttgatgattatgtgtctgaatttgatgggggcaggcggcccccgtctgtttgtcgcgggtctggtgttgatggtggtttcctgccttgtcaccctcgagcttacgggcattaccgtgtcgttcaatagtgcgccgctggaatggtggctctcccttcccattattgtcgtttatcctctgctgtttggctgggtcagctaccagacggcaaccaaactggcggaacataaacgcaggttgcaggtcatgagtacccgcgacggcatgacgggcgtgtataaccgacgtcattgggaaactatgttacgcaatgaatttgataactgtcggcggcataatcgcgatgcaacgttactgattatcgatatcgaccatttcaagagcatcaacgatacctggggtcatgatgtgggcgatgaagcgattgtggcgcttacccgacagttacaaattaccctgcgcggtagcgatgtgattggtcggtttggcggcgatgagtttgcagtaatcatgtccggtacgccagctgagagcgccattaccgccatgttacgggtgcgtgaagggctaaacacgttacgcttgccgaatacgccacaggtaactttacggattagtgtgggggttgcgccgctgaacccacaaatgagtcactatcgtgagtggttgaaatcggcagatttggcgctttacaaagcaaagaaagccggacgtaaccgcaccgaagtggcggcctgacgtccggcgaaagtcatcaggatttgctgagtttttctgatttttccatacacttcgtcatcgcttcgatcactgcggcacggaagcctttctcttccagtacgcgtaccgcttcaatggtggtgcctcccggtgagcagaccatatctttcagtgcccccggatgttctcccgtttccagcaccatttttgcggaacccattaccgcctgagcggcaaatttatacgcctgggcgcgtggcatcccgcccagcacggcggcgtcggccatcgcttcgataaacataaatacgtaggctggcgaagaaccgctcacaccgaccaccgggtggatcatcggctcagcaattacttccgcttcgccaaagcagcggaaaatattcagcacatcagcggtatcttctggggttaccagcgcgtttggcgttacggaggtcatcccggcattaaccagcgcgggagtgttcggcatggcgcggataattttccggtcatggcccagcgcgcgggcaagctggtcgagcgtgacacctgcagcaatagaaacgaccagagagtctttattcaggctggaggtgatttcgctaagcactttaatcatgatgccaggtttaacggcagcaaaaatgatgtcggcgatttgcgccacttcttgcgccgattctgcggcgttgatgccgaactggtcatgcagggcggcgactttatccggggagggggtgtatacccagatttgccctggaagcacctgaccgctggcaatcagaccgccgagaatggcttttcccatattgccgcagccaataaaaccgattttcttttccattgcctcactcctgccgtgaaattcattgttttgataatcgctggcagaagcataaacagaactatgccggaaggcaaaagcgcgacacaatagaggattacccaacaaaggatgactttatgacaatttgggtggatgccgacgcgtgtcccaatgtaattaaagagattttgtatcgcgcggcggaacgtatgcagatgccgctggtactggtagcaaaccagagtttacgcgtgccgccatcgcgatttattcgtacgctgcgcgtcgcggcaggtttcgacgttgccgataacgaaattgtccggcagtgtgaagcgggcgatttggtgatcaccgcagatatacctttggctgctgaagccatcgagaaaggcgcagcggcgcttaatccgcgcggcgaacgttacacgccagcgaccattcgtgagcgcctgacgatgcgcgattttatggataccttacgtgccagtgggatccagaccggcggaccagatagcctttcacaacgtgaccgccaggcctttgccgcggagctggagaagtggtggctggaagtgcaacgtagtcgtggctaaatgtaatttattatttacacttcattcttgaatatttattggtatagtaagggatgtattgagattttcactttaagtggaattttttctttacaatcgaaattgtactagtttgatggtatgatcgctattctcatgacaccggctttcgccgcattgcgacctattggggaaaacccacgatgacacaacctctttttctgatcgggcctcggggctgtggtaaaacaacggtcggaatggcccttgccgattcgcttaaccgtcggtttgtcgataccgatcagtggttgcaatcacagctcaatatgacggtcgcggagatcgtcgaaagggaagagtgggcgggatttcgcgccagagaaacggcggcgctggaagcggtaactgcgccatccaccgttatcgctacaggcggcggcattattctgacggaatttaatcgtcactttatgcaaaataacgggatcgtggtttatttgtgtgcgccagtatcagtcctggttaaccgactgcaagctgcaccggaagaagatttacggccaaccttaacgggaaaaccgctgagcgaagaagttcaggaagtgctggaagaacgcgatgcgctatatcgcgaagttgcgcatattatcatcgacgcaacaaacgaacccagccaggtgatttctgaaattcgtagcgccctggcacagacgatcaattgttgattttagagcgcctatacttaacgttcatcccgtgaaataaggaagaacgatgccaacgaaaccgccttatcctcgtgaagcatatatagtgacgattgaaaaaggaaagccaggacagacggtaacctggtaccaactcagagccgatcatcctaaaccagactcgttgatcagtgaacatccgacggctcaggaagcgatggatgcgaaaaaacgctatgaggaccctgacaaagagtgaccgcatcagactgctcggaagggattctgagtgccactacaagggatctgcgtcacatttttcataattcatgtttttctaataattagaatattaaacaataacaatccattactggaatcatttggaatctttacattatgccgtgcacgtctgctgctacgctttttgtcatttgtagcacaagtaagtgtcagcagtggtgcttcacacttgcccggtaattaacgacgaaagaaaagtaaggtggatgaacaatgagtgcgtcgttggcgatcctgaccatcggcattgtacctatgcaggaggttttgccgctcctgacggaatacattgacgaagataatatttcccatcatagcctgctggggaagttaagtcgtgaagaagtgatggcggagtacgcgccagaagcaggcgaagacaccattctcacattattaaatgacaaccagctggcccatgtttcgcgtcgtaaagtggagcgagacctgcaaggtgtggttgaagtgctcgataatcagggttatgacgtcattttattaatgagtacagcaaacattagtagtatgactgcgcgtaatacgatctttcttgagccgtcgcgaatattgcctccactggtttcctctattgttgaagatcatcaggtgggggttatcgttccggttgaggagatgctgcccgttcaggcgcaaaaatggcaaattttgcagaaatcgccggtattttcattgggtaaccccattcatgattcagaacaaaaaatcattgatgccgggaaagaattactggcaaaaggggctgatgtcatcatgctggattgtttaggatttcaccaacgtcatcgcgatttactgcaaaaacagctcgatgttcctgtcttgctgtctaacgtattgattgcacggctggctgcggaattactggtgtaattttgcgtgacagtcagcgcctctggcccctatagtgaagtagatgttcaactaccaaacagggccagtttatgcttcaaagtaatgagtacttttccggcaaagtgaaatcaatcggcttttccagcagcagcactggtcgcgccagcgtgggtgttatggttgaaggcgaatacaccttcagcaccgctgagccggaagagatgacggtaatcagtggcgcgctgaatgtgttactgcctgacgcgaccgactggcaagtgtatgaagccggttcggtgtttaatgttcccggtcacagtgagtttcatctgcaagttgccgaacccacctcttatctgtgccgctatctgtaattcctcgccttccccttgaacgggagggcatttttctgaaatatcctctctttaacccataataatatttcctttgctgcgattttttcaatttccggtatattcataattcatcaaggttgatataaatatcagtgaagatctccagatattgttgcggaactggctacgataaaagataaatcagatgatgaatggtggcgtgcattgctgcaaagtcgcaatgatcatttgcgccaaacggcattacgcaacgcacataccccggcgtcgttgttaacgacattgaccgagtctcggcatcggtcgctagctatgaataatccacagctcgctgccgatgtgaaaacgacgtggttaaaagaggatccatcattactcttatttgtcgaacaacccgatctttcgctgttacgggatttagtgaaaaccggggcaatgcggaaaattcgcagtgaagcgcgtcactggcttgaggaaaaacaatgacacaacgtccatggagcaagttacagcataaaacgcataatattgctgcgctaaaaattattgcccgccgtagcgaataattatatgcctggtgtggcttcgtacgccggataagacgcggcaggcgtcgcatccggcattaaaggaaaatcagcaattaacgttgtgcttcgccacctaatccttcaatcaggttttgaattaacgctgccagttcaccagtcatcaggatgaaatcggcatcaaaacgctgggcgaaatcttcacggtcgatatcttcgttttgatcgcgcagctcgtcgcagaacttcagacgcttgagcgaaccatcgtcgcacatcacaaactgaatgcgctgctgccagtcgagcgccagtttagtcaccacttttccggcttcaatgtgattggtgatctcttcgctggtcagatcttgtttcttcgcgcggatcacgccgccatcttccagcaacgatttcagctcggcttcatcaagcagctggaagccctgtgccgcactaccggagcgaacccattcggtcaacgtcagttcaatcgggttttccatgctcaatggtacaaccggtaacgaccccaggcttttacgcagcagtgccagcgtatcttccgcttttttggcactggcgcagtccaccataatcaaaccgttaaccgtgtcgatccacatcattgtctggctaaaacggctgaaagcacgcggcaacagagagtgcagcacttcgtctttcagcgaatctttttcggttttcttcagcttacgcgcctgttccgcttccagtttggcgattttcgcttccagcgcctgcttaatcaccggagacgggaggattttttcttctttgcgcgcgcagataacaatttgaccattggcaacgtgcgttaacgcatcgctgtgcgatcccatcggaggaacccagcccatcttcgccatgtcctggctgccgcatggggtaaatgccatcgaggctagctgtttttccatctcttctgcacgcagcgaaatctcgcggctaagacggtaaaccattaaatttttgaaccacagcatgataatttccacggccttgtcgttaaatttagcgggcatgataacgaattgtcggcggccttgcattgccaatccggttgtccgtctctacgctattgatattgaaaaaaataaggagagtaccgtgcgtataggtatcgatttaggcggcaccaaaactgaagtgattgcactgggcgatgcaggggagcagttgtaccgccatcgtctgcccacgccgcgtgatgattaccggcagactattgaaacgatcgccacgttggttgatatggcggagcaggcgacagggcagcgcggaacggtaggtatgggcattcctggctcaatttcgccttacaccggcgtggtgaaaaatgccaattcaacctggctcaacggtcagccattcgataaagatttaagcgcgcggttgcagcgggaagtgcggctggcaaatgacgccaactgtctggcggtttcagaagcggtagatggcgcggcagcgggagcgcagacggtatttgccgtgattatcggcacgggatgcggcgcgggcgtggcattcaatgggcgggcgcatatcggcggcaatggcacggcaggcgagtggggacacaatccgctaccgtggatggacgaagacgaactgcgttatcgcgaggaagtcccttgttattgcggtaaacaaggttgtattgaaacctttatttcgggcacgggatttgccacagattatcgtcgtttgagcggacatgcgctgaaaggcagtgaaattatcagcctggttgaagaaagcgatccggtagcggaactggcattgcgtcgctacgagctgcggctggcaaaatcgctggcacatgtcgtgaatattctcgatccggatgtaattgtcctggggggcgggatgagcaatgtagaccgtttatatcaaacggttgggcagttgattaaacaatttgtcttcggcggcgaatgtgaaacgccggtgcgtaaggcgaagcacggtgattccagcggcgtacgcggcgctgcgtggttatggccacaagagtaaaaaacgtaggcaattggcgcatcatgcttgatgcgacgcttgccgcgtcttatcaggcctacaaaatgtgccggaaccgcgtagggcggataaggcgttcacgccgcatccggcaataagcaacgcgcaacgtgactgcaatctaccccagtggtttcgccagcaccggactatccgccgcttgctggcgcttatagcgaccatacagcagcaatgacgacatcgcagcaaacgaaagcagggcggcaggcagcgccacgtaattatatgccagccccagcgtcagcatcataccaccgcaatatgcgccgacggcgctaccaaggttaaacgctatttgcccacctgcggcacctaataactctccgcctttggcattttgtagtaataatatttgcagaggtgctgaaagggcaaataatcccgcgcaacaaataaaagcaaaaataagcgacgttgttttcatgccgccgcagaaaaagagcatcagcagtgccagtacaattataaagtcagtcactgctgcaatgcgcagtggtgaataacgtcctgaaatcctgccacttagcatatttcccaacaccatccctagcccaactaacatcataataaaggtcatcgccgtttccgaaaaaccggaaataaacatcatgtatggctttacgtagctgaaccaggcaaacacacctgcgttgccaaacatcgtggcggcgaaaattaaccacggggccgggctgcgtaaaaagtgaaattgttcgcgcagctttcctttcgcctcgtcgcgaatatccggcacccaaaaatagaccgatgccatcaccgcaatattaaaaacagcgatcaataaaaaggtgtaacgccagctaaattcctgacttaaatacgttcccagcggaatgcccagcaaattggcgactgtcatcccggaaaccatccccgccacggcggcggtgacttttccgggtttgataatttttgataacacgatcgcgccgacgccaaaaaatgcgccatgcggaaagccggaaaccaggcgaccaatggcaagcatcaggtaagacgaagagagcgtgaacatggcgttgccaatgacgcacaacgccaccagaaacaacaagatatgtttgagtgagtagcggctggaaaagagtgcgatgattggcgcaccgaccaccactcccagcgcataatacgagatcatatgcccggcagcaggaatcgaaattcctacgttatgcgccagctccgtgagcacgcccataatgccaaattcggccatccccaaaccaaacgtgcccagagccaaagataaaatgacttttttcataccaccatcacaactaccagaacggctaccaatcaccgtagccaataaagtgatagcttgcaggataacgaccagcaaggccaagagataattcgcccctctgtattcattatcctgctgaatagttatttcactgcaaacgtactttccagtttgctgtagcccaggccgttgatctttttcactttgatctgcaccggaatacgctctttcatcgcttctacgtggctaatcacaccgatggttttgccactggcgttcagggcatccagcgcatcaagggcggtatccagcgtttcgctatccagcgtgccaaaaccttcatcaaggaacagcgagtcaatacgtgttttatggctgaccagatccgaaagcgccagcgccagcgccagactaacgaggaaactttcgccgccggaaagggtacgggtatcgcgtaccgcatctgcctgccaggtatcaacaacctcgacttccagcgcctcgctggctttgcgctgtaacagatagcgcccgtgcagccgggtaagttgctgattagcgagatggactaaattatccagcgtcagcccctgggcaaacttgcggaatttatcgccctctttggaacctattagcgaattcagatatccccagtcctcaacctgctgcgtcatttgagcaatttgctgcattaaggtttgttgttgctgacggttatctgcatcctgcttcagctgctggcgaatctcgccttgactcgtggtgttttcacgcaacttttggtgagtttgcgctaactcttgctgaatctgctccaccgtcacagtgagagccaacccgtcaggtcggtgttgttgatgctgtgccagcgtttctgctgtctgagtgaccagcgtttgcgcctgacggcgctggttttccagattctgcttgagctgttccagctgcgttagtgtttgttcatccattagcgccgcaaggaacgcctgctgatcgtcaaagacgctggcctgtagcgcggtgtcaaactgcgcctgggctttttgcagactttgcgccgccagaacatcctgttgctgtaacgtctgctgctggctgtgtaatgcgagacattgttcatgaacctgccgccagttatccagcgccacagtttcttcgctgtgcgggagatcatcactttgcggcaacgtttccagaatcggcgtcagctgctgaatacggttttgcagcgcggttaattcgttctggcgttgctgccagctctgcgcttcttgctgacgtgtcgccaaccagctctcttcttcatcttcctgtggcaatgtcagtgcataacccgccaatgccgttaagagctgctgctggcgttgttcaatttgctgttgatactggataatttgctgattatgcgcggcaatctgcccttgtaattcatgtcgttggctgagtaaccgcagctggcgttcgtgctcatcttgtgcatcaagccacggttgaatatcgtcctgtggctgcaaggtgatattgaggctggccgtgacggcttgccattgttgagtaagtgcttgctcatcttgtcggaggctttgcgcttcgttttcatcgcgctgaagctgcttcgttaatgcatccagttgcccgcgcagcgccgcaccttcttcgccgagctttttaacttcgttttccagcgccagtaatcgagactgattaacgccaggctccagcgcctgatacgcctcgaccgccgggtggctggtggaaccacaaagtggacaaggctgacccgcctgtaactgtgcacgttgagcttccagcgttttgatgcgcgcttcctgctcgcaaatggttttcacatcggcaagttgctgcgtcttttctttataacgctggcgcatttcgttaagtgcggcgttacgttgcgtctgttcttgcgtgacattctggatagcgacctgtaactgcgccagacgtttttgttggggaacaatctgtccatgtagcgcgaccaggtgctgacgcagtgggcgttgctcagcatgttgcgccagggcggtagcaacttcatcggcggttaacgtcaacgtgatcgccgcaagcgcattaagtttttgctcagcatgggttaactgttgctgccattgccgcagatgctcgcgatcgctggtttgttgggagaactgcgcacgccaacccgccagttcgttgttccactgacggaagcggtcgtgttcctgtaaccaggtattcaggctttgttgctgctgctgtaattctgctgactgcttcgccgcgtggtggcgaatgctcgcgcgaagcgccattgtgctctgtaagcgagtatttacttcttcaatctgctggcgagtatgcgccagcgccgcgctgtgttctgcgatgcgttcccagtgcggacgaagatttcgtgccggttgtgccagactgagcgccgccagttgaggttgcgctttttcttcttcggctaacgcctgttgcaaggcctgctgacggcggctggcttcttgctgcaattcgtccagacgcgttaaccagtttagtgattgttgttcttgctgctgcgcggtaagtaactgtttttcttcgtcagtaagtacctgcaaactcgctgtcagcgattgcacttgttccggcgtgagcaacgcgacgccgctggcctgcgcttgcagcttctccagctcagtgcgggccgatttgtgctgctcaaaaaccatcgccgagatttgcccgtagatttcagtgccggttaactcctcgagcaattccgcgcgttctttgggtttggcattcaggaaggcagcaaattgcccctgcgaaagcagcatcgaacgggtgaagcgcccgtaatccagcccggttaacgttgctgtcagttctagcttatctttcactttgtcggcgagaattttgccgtcggcgcagcgcgccagctcaacgcgtggcacctgcaaattaccgtcgggttggttacgcgcccgattctggctccagaatgcacggtacgcttcacctttcacttcaaactccacctccgccagacattcagcggtatcgcgggtcatgagatcattttgcgattgtgaaacgttagagagacgcggagtttcgtgatacagcgccagacaaatggcgtccagcagggtggttttccccgcaccggttgggccggtaatggcaaacagcccgttgctggcgaacggctcgcgggtgaaatcaatcttccattcgccttttaatgagttcaggtttttcaggcgcaggctgagaattttcatgcttcgtgttctccggcgagggtatgcaacgtcgtggtgaaaagatgctgcagacgttgctgctgcgattcatccagttcttccagtgccagacggcgattgaacacctcttcgacgctgagttcgctgagggtttcacgctgttggctggctaacacacgctcgcgctgttcacgactccggcgtaccagcaatacttcaacaggcaatgattcggttaatgcctggattttgcgctgaatatcatgcagatactcatcagtagtgatttcgatatccagccagacaggcggctcctgtgatacatcgcgccactgttccagctgtgcggtaatcgacgccagatcgcctttcagcaccgccatgggttgcgttaccggtacgttcaggttttccacgctctctaatttgccgtttgaaaatgtcaccagatggacatatttactctttccgcattcatcaaaactcagtggaatgggagagccgcaatagcgaacatgttccatgccgccaataatctgtgcgcggtgaatatgcccgagcgcgatgtagtcggctggtggaaagttttgtgctggaaacgcgtccagcgtgccaatataaatgtcacgcacggcgtcacttttactggcacccacggtcgttaagtgtcccgtggcgatgatgggcagaggctgatcgccgcgcagtttgcaggcatcggcatagtgttgttggtaataatcggtaatcgctgccagtaaatgctgctgtttttcaataccgttaagccccgcctggctggtaataatgtcacgcggacgtaaaaacggaatggggcacagcactgcgcctggcgtcccgtcgcgacgaggcaagatttgcggcgcatgtccggcgctggcgaccacggtcgtattgaggaacgccatgatatcgcgcgattcattcagcgtggcgaccgagtcatggtttcctgccagtaccaccagatgacagccagtttgctgtaaattgacaacaaaacggttgtataacgtgcgggcgtaactgggcggcgagccggtatcgaaaacatcaccagcaacaataatcgcatccacctgatgggtttgtgctgtttccagcagccagtcaagaaaagcctgatgttcagcttcgcggcttttactgtagaagttctggccgagatgccagtctgaggtgtgaaggatgcgcataacgattccctggcgaaaaagcatgggcgcgattatacccaaacagatgtgccatttgcttttttctgcgccacggaaatcaataacctgaagatatgtgcgacgagcttttcataaatctgtcataaatctgacgcataatgacgtcgcattaatgatcgcaacctatttattacaacagggcaaatcatggcgagacgtattctggtcgtagaagatgaagctccaattcgcgaaatggtctgcttcgtgctcgaacaaaatggctttcagccggtcgaagcggaagattatgacagtgctgtgaatcaactgaatgaaccctggccggatttaattctccttgactggatgttacctggcggctccggtatccagttcatcaaacacctcaagcgcgagtcgatgacccgggatattccagtggtgatgttgaccgccagaggggaagaagaagatcgcgtgcgcggccttgaaaccggcgcggatgactatatcaccaagccgttttcgccgaaggagctggtggcgcgaatcaaagcggtaatgcgccgtatttcgccaatggcggtggaagaggtgattgagatgcagggattaagtctcgacccgacatctcaccgagtgatggcgggcgaagagccgctggagatggggccgacagaatttaaactgctgcacttttttatgacgcatcctgagcgcgtgtacagccgcgagcagctgttaaaccacgtctggggaactaacgtgtatgtggaagatcgtacggtcgatgtccacattcgtcgcctacgtaaagcactggagccaggcgggcatgaccgcatggtgcagaccgtgcgcggtacaggatatcgtttttcaacccgcttttaacgccttgctcatcggacgcagagcagggcttatgatttcttaactggagtatcttacgtgctggaacggctgtcgtggaaaaggctggtgctggagctgctactttgctgcttcccggctttcatcctgggtgcattttttggttacctgccctggtttttgctggcatcggtaacgggactgcttatctggcatttctggaatttattgcgcctttcatggtggctgtgggtggatcgtagtatgaccccgccaccggggcgtggtagctgggaaccgctactatacggcttacaccagatgcagctgcgaaataaaaaacgccgccgtgaactgggcaatctgattaaacgctttcgtagcggcgcggagtcgctgcccgacgcagtggtgctgaccactgaagagggcggtattttctggtgtaacggtctggcgcaacaaattcttggtttgcgctggccggaagataacgggcagaacatccttaacctgctgcgttacccggagtttacgcaatatctgaaaacgcgtgatttttctcgcccgctcaatctggtgctcaacaccgggcggcatctggaaattcgcgtcatgccttatacccacaaacagttgctgatggtggcgcgtgatgtcacgcaaatgcatcaactggaaggggcgcggcgtaacttttttgccaacgtgagccatgagttacgtacgccattgaccgtgttacagggttacctggagatgatggatgagcagccgctggaaggcgcggtacgcgaaaaagcgttgcacaccatgcgcgagcagacccagcggatggaagggctggtgaagcagttgctgacgctgtcgaaaatagaagccgcaccgacgcatttgctcaatgaaaaggttgatgtgccgatgatgctgcgcgttgttgagcgtgaggctcagactctgagtcagaaaaaacagacatttacctttgagatagataacggcctcaaagtgtctggcaacgaagatcagctacgcagtgcgatttcgaacctggtctataacgccgtgaatcatactccagaaggcacgcatatcaccgtacgctggcagcgagtgccgcacggtgccgaatttagcgttgaagataacggaccgggcattgcaccggagcatattccgcgcctgaccgagcgtttttatcgcgttgataaagcgcgttcccggcaaaccggcggtagcggattagggttagcgatcgtgaaacatgcggtgaatcatcacgaaagtcgcctgaatattgagagtacagtaggaaaaggaacacgtttcagttttgttatcccggaacgtttaattgccaaaaacagcgattaatccgcctttgtcatcttttattgccataagccagccgatgctggcttattttctttgcagtcaaaatacgggcgttagattttacaacggttggtgattttttgttcgcatgattagccatgtctttttcacggaaatagtgttttatactggttggtgatttcttatcgctatatacctctggtttttagatccctccttgctttaaaacgttataagcgtttaaattgcgcttcaggtgctgtcatactgactgcattaacgcggtaaatcgaaaaactattcttcgccgcgcctggttgggagtatttcccgctaaaattgtttaaatataccgctgtatcatccccagggattggcacaaaaatttaacgttacaacaccacatccacaggcagtatgatttatgacccatcaattaagatcgcgcgatatcatcgctctgggctttatgacatttgcgttgttcgtcggcgcaggtaacattattttccctccaatggtcggcttgcaggcaggcgaacacgtctggactgcggcattcggcttcctcattactgccgttggtctgccggtactaacggtagtggcgctggcaaaagttggcggcggtgttgacagcctcagcacgccaatcggtaaagtcgctggcgtactgctggcaacggtttgttacctggcggtggggccgcttttcgctacgccgcgtacagctaccgtttcctttgaagtggggattgcgccgctgactggtgattccgcgctgccgctgtttatctacagcctggtctatttcgctatcgttattctggtttcgctctatccgggcaagctgctggataccgtgggcaacttccttgcgccgctgaaaattatcgcgctggtcatcctgtctgttgccgcgattgtctggccggcgggttctatcagcacggcgactgaggcttatcaaaacgctgcgttttctaacggcttcgttaacggctatctgaccatggatacgctgggcgcaatggtgtttggtatcgttattgttaacgcggcgcgttctcgtggcgttaccgaagcgcgtctgctgacccgttataccgtctgggctggcctgatggcgggtgttggtctgactctgctgtacctggcgctgttccgtctgggttcagacagcgcgtcgctggtcgatcagtctgcaaacggcgctgctattctgcatgcttacgttcagcacacctttggcggcggcggtagcttcctgctggcggcgttaatcttcatcgcctgcctggtaacggcagttggcctgacctgtgcttgtgcagaattctttgcccagtacgtaccgctctcttatcgtacgctggtgtttatcctcggcggcttctcgatggtggtttctaacctcggcttaagccagctgatccagatctccgtaccggtgctgaccgctatttatccgccgtgtatcgcactggttgtattaagttttacacgctcatggtggcataattcgtcccgcgtgattgctccgccgatgtttatcagcctgctttttggtattctcgacgggatcaaagcatctgcattcagcgatatcttaccgtcctgggcgcagcgtttaccgctggccgaacaaggtctggcgtggttaatgccaacagtggtgatggtggttctggccattatctgggatcgcgcggcaggtcgtcaggtgacctccagcgctcactaaatcactgaacatttgttttaaccacggggctgcgatgccccgtggttttttattgtgttgatgggttaggaattgatggaaagtaagaacaagctaaagcgtgggctaagtacccgccacatacgctttatggcactgggttcagcaattggcaccgggctgttttacggttcggcagacgccatcaaaatggccggtccgagcgtgttgttggcctatattatcggtggtatcgcggcgtatatcattatgcgtgcgctgggggaaatgtcggtacataacccggcagccagctctttctcgcgttatgcgcaggaaaacctcggcccgctggcaggttacattaccggctggacctattgctttgaaatccttattgtcgccatcgccgatgtgaccgcttttggtatctatatgggtgtctggttcccgacggtgccgcactggatttgggtactgagcgtggtgctgatcatttgcgccgtaaacctgatgagcgtgaaggtcttcggtgagctggaattctggttctcgttctttaaagtcgccaccatcatcatcatgattgtcgccggtttcggcatcatcatctgggggattggcaacggcgggcaaccgaccggtattcataacctgtggagcaacggcggcttcttcagtaacggctggcttgggatggtgatgtcgttgcaaatggtgatgtttgcttacggtgggatcgaaattatcgggattaccgccggtgaagcgaaagatcctgagaaatcgataccgcgtgcgattaactccgtgccgatgcgtattctggtgttctacgtcggtacgctgttcgtcattatgtctatctacccgtggaatcaggttggcactgccggtagcccgttcgtgctgacgttccagcatatgggcattacctttgccgccagcattcttaactttgttgtgctgactgcttcgctgtcggcaattaacagtgacgtatttggcgtaggccgtatgctccacggtatggcagagcagggcagcgcgccgaaaattttcagcaaaacgtcgcgtcgcggtattccgtgggttacggtgctggtgatgactaccgcgctgctgtttgcggtgtatctgaactacatcatgccggaaaacgtcttcctggtgatcgcttcgctggcaaccttcgccacggtgtgggtgtggattatgatcctgctgtcgcaaattgccttccgtcgccgtttgccgccagaagaagttaaggcgctgaaatttaaagtgccgggtggggtagcaacgaccatcggcggtttgattttcctgctctttattatcgggttgattggttatcacccggatacgcgtatctcgctgtatgtcggtttcgcgtggattgttgtgctgttgattggctggatgtttaaacgccgccacgatcgtcagctggctgaaaaccaataatacttgcgttctgtaagccggttcaggaggaaatcctgatccggctattccgaaagttatccgcccccgtcctcctcccccaaatatccttcagatgatgagtgatcctgcattaggctatggcaaggtgatcagattttcatcacaggggaattatgatgttaaatgcatggcacctgccggtgcccccatttgttaaacaaagcaaagatcaactgctcattacactgtggctgacgggcgaagacccaccgcagcgcattatgctgcgtacagaacacgataacgaagaaatgtcagtatcgatgcataagcagcgcagtcagcagcagcctggcgtcaccgcatggcgtgtggcgattgatctctccagcggacaaccccggcggcgttacagtttcaaactgctgtggcacgatcgccagcgttggtttacaccgcagggcttcagccgaatgccgccggcacgactggagcagtttgccgtcgatgtaccggatatcggcccacaatgggctgcggatcagattttttatcagatcttccctgatcgttttgcgcgtagtcttcctcgtgaagctgaacaggatcatgtctattaccatcatgcagccggacaagagatcatcttgcgtgactgggatgaaccggtcacggcgcaggcgggcggatcaacgttctatggcggcgatctggacgggataagcgaaaaactgccgtatctgaaaaagcttggcgtgacggcgctgtatctcaatccggtgtttaaagctcccagcgtacataaatacgataccgaggattatcgccatgtcgatccgcagtttggcggtgatggggcgttgctgcgtttgcgacacaatacgcagcagctgggaatgcggctggtgctggacggcgtgtttaaccacagtggcgattcccatgcctggtttgacaggcacaatcgtggcacggggggagcttgtcacaaccctgaatcgccctggcgcgactggtactcgtttagtgatgatggcacggcgctcgactggcttggctatgccagcttgccgaagctggattatcagtcggaaagtctggtgaatgaaatttatcgcggggaagacagtattgtccgccattggctgaaagcgccgtggagtatggacggctggcggctggatgtggtgcatatgctgggggaggcgggtggggcgcgcaataatatgcagcacgttgctgggatcaccgaagcggcgaaagaaacccagccggaagcgtatattgtcggcgaacattttggcgatgcacggcaatggttacaggccgatgtggaagatgccgccatgaactatcgtggcttcacattcccgttgtggggatttcttgccaataccgatatctcttacgatccgcagcaaattgatgcccaaacctgtatggcctggatggataattaccgcgcagggctttctcatcaacaacaattacgtatgtttaatcagctcgacagccacgatactgcgcgatttaaaacgctgctcggtcgggatattgcgcgcctgccgctggcggtggtctggctgttcacctggcctggtgtaccgtgcatttattacggtgatgaagtaggactggatggcaaaaacgatccgttttgccgtaaaccgttcccttggcaggtggaaaagcaggatacggcgttattcgcgctgtaccagcgaatgattgcgctgcgtaagaaaagtcaggcgctacgtcatggcggctgtcaggtgctgtatgcggaagataacgtggtggtatttgtccgcgtgctgaatcagcagcgtgtactggtggcaatcaaccgtggcgaagcttgtgaagtcgtgctacccgcgtcaccgttgctcaatgccgtgcaatggcaatgcaaagaagggcatgggcaactgactgacgggattctggctttgcctgccatttcggctacggtatggatgaactaacgttttataacgccttgtgtgacgcctgcgccatcatccgcggataaaactgccagaagcgggtttcgagggcgtcataatgagcgtctaaatcgtaccaggagtcacgcagggcatccagacgtgggcggcggcttgccatgccgtttaacacgttctggatgaaatccatatcgcgatagcgcaccagccactgctctgaccacaagtaattgttcagattgataaaacgtggcggtgagtccggcaaaatcgtcatcacttgctcgcgggcataacagacaaattcctgtagcggaaagtccggcgacagctgcgaccagtggcgggaaagaaagtgatcccacatgacatccagcgtaataggcgcaacgcggcgagtttcactacgaaaccattcccgtgcttcgcggacttccggcagattgtcggttaatacgtcgatacgtcgatgcatatgaatgccagccacgacgtcgggcggaaaactttcttcaggatttccgcgtacgaaatcagccagtaaattgccggaaagcgagctttccgcgagatgggctaaatgcaggtgagctaaaaaattcatcgattatattctatccaaaagggggtaaaggttgcagggagagcgccccggcactagactacccgcctcttattttagtctgagtcagtgtcatgcgcgttaccgatttctcctttgaattgcccgaatccctgattgcccactatcccatgcctgaacgcagtagctgtcgtttactgtcgctggacgggccgacgggcgcgctgacgcacggtactttcaccgatttacttgataagctcaaccccggcgatcttctggtttttaataatacccgcgtgatcccggcgcgcctgtttgggcgtaaagccagcggcggcaagattgaagtgctggttgaacggatgctcgacgacaaacgcattcttgcgcatattcgcgcctcgaaagcgccaaaacctggcgcagaactgctgctgggcgatgacgaaagtattaacgcaacaatgaccgcgcgccacggcgcactgtttgaagtcgaatttaatgatgaacgctcggtgctggatattctcaacagcatcggccatatgccgctgccgccgtatatcgaccgtccggacgaagacgctgaccgcgaactttatcaaaccgtttatagcgaaaaaccgggcgcggttgcagccccgaccgcaggtctgcattttgacgaacctttgctggaaaaattacgcgccaaaggcgtggagatggcgtttgtgacgttgcacgttggtgcgggcaccttccagccggtgcgcgtcgacaccattgaagatcacatcatgcactcggaatacgctgaagtgccgcaggatgtggtagacgcggtactggcggcgaaagcgcgcggtaaccgggtgattgcggttggcaccacctcagtacgttcgctggaaagcgcggctcaggcggcgaaaaacgatcttatcgaaccgttctttgacgatacccaaatctttatctatccgggcttccagtacaaagtggtcgatgcgctggtgacaaacttccacctgccggaatcgacgctgattatgctggtttcggcctttgccggttatcaacacaccatgaatgcctataaagcagcggtagaagagaaatatcgcttttttagttacggtgatgcgatgtttatcacgtacaatccgcaggcaattaatgagcgcgtcggggagtaattccgcggcgctggtttaaaacgttggactgtttttctgacgtagtggagaaaaaatgaaatttgaactggacaccaccgacggtcgcgcacgccgtggccgcctggtctttgatcgtggcgtagtggaaacgccttgttttatgcctgttggcacctacggcaccgtaaaagggatgacgccggaagaagttgaagccactggcgcgcaaattatcctcggcaacaccttccacctgtggctgcgcccgggccaggaaatcatgaaactgcacggcgatctgcacgattttatgcagtggaaggggccgatcctcaccgactccggcggcttccaggtcttcagccttggcgatattcgtaaaatcaccgaacagggcgtgcacttccgtaacccgatcaacggcgatccgattttcctcgatcctgaaaaatcaatggagattcagtacgatcttggttcggatatcgtcatgatctttgatgagtgtacgccgtatcctgctgactgggattacgcaaaacgctccatggagatgtctctgcgttgggcgaagcgtagccgtgagcgttttgacagtctcggaaacaaaaatgcgctgtttggtatcattcagggcagcgtttacgaagatttacgtgatatttctgttaaaggtctggtagatatcggttttgatggctacgctgtcggcggtctggctgtgggtgagccgaaagcagatatgcaccgcattctggagcatgtatgcccgcaaattccggcagacaaaccgcgttacctgatgggcgttggtaaaccagaagacctggttgaaggcgtacgtcgtggtatcgatatgtttgactgcgtaatgccaacccgcaacgcccgaaatggtcatttgttcgtgaccgatggcgtggtgaaaatccgcaatgcgaagtataagagcgatactggcccactcgatcctgagtgtgattgctacacctgtcgcaattattcacgcgcttacttgcatcatcttgaccgttgcaacgaaatattaggcgcgcgactcaacaccattcataaccttcgttactaccagcgtttgatggcgggtttacgcaaggctattgaagagggtaaattagagagcttcgtaactgatttttaccagcgtcaggggcgagaagtaccacctttgaacgttgattaatattaataatgagggaaatttaatgagcttttttatttctgatgcggtagcggcaacgggtgcaccggcgcaaggtagcccgatgtctttgattttgatgctggtggtattcggtctgattttctatttcatgatcctgcgtccacagcagaagcgcaccaaagaacacaaaaagctgatggactccattgccaaaggtgatgaagttctgacgaacggtggcctggttggtcgcgtaaccaaagtagcggaaaacggctacattgctatcgcgctgaatgacaccactgaagtagttattaaacgtgacttcgtagctgccgtcctgccgaaaggcaccatgaaggcgctgtaattaaaatttttccctaagggaattgccgtgttaaaccgttatcctttgtggaagtacgtcatgctgatcgtggtgattgtcatcggtctgctgtatgcgcttcccaacctgtttggtgaggatccggctgttcagatcactggtgcgcgcggagtcgccgccagtgagcaaacgctgatccaggtccagaaaacgttacaagaagaaaaaataactgctaagtctgtggcactggaagagggcgctattcttgcgcgcttcgactccactgacacccagctgcgcgctcgtgaagcattaatgggcgttatgggtgacaaatacgtcgtggcgcttaaccttgccccggcaacgccgcgctggctggcagctattcacgctgagccgatgaagctcggccttgacctgcgtggcggcgttcacttcctgatggaagtggatatggacaccgcgcttggcaaactccaggaacaaaatatcgatagcctgcgcagcgatctgcgtgaaaagggcatcccgtataccaccgttcgtaaagaaaacaactacggcctgagcattactttccgcgatgctaaagctcgtgatgaagccattgcgtatctgagcaagcgccatccggacctggtgattagtagccagggcagcaaccagctgcgtgcggtaatgagcgatgctcgtctgagtgaagcgcgtgaatatgcggtgcagcagaacatcaatatcctgcgtaaccgtgtaaaccaacttggcgtggcggagccggtggttcagcgtcagggtgctgaccgtatcgttgttgaactgccaggtattcaggacactgcgcgtgcgaaagagattctgggtgcgacggcaacgctggaattccgtctggtaaacaccaacgttgaccaggccgctgcggcatccggtcgcgtaccgggcgactctgaagtgaaacagacccgcgaaggtcagccagttgtgctgtacaaacgcgtaattctgaccggtgaccatatcaccgactccacttccagccaggacgaatacaaccaaccgcaggttaacatctcgctcgatagcgctggtggtaacatcatgtctaacttcactaaggacaacatcggcaaaccgatggcaaccctgtttgtggagtacaaagacagcggtaagaaagatgcaaatggtcgtgcggttctggtgaaacaggaagaggtgattaacatcgccaacatccagtctcgtctgggtaacagcttccgtatcaccggcatcaacaacccgaacgaagcccgtcagctgtcactgctgctgcgtgccggtgcgttgatcgcgccgattcagattgttgaagaacgtaccattggcccaaccctgggtatgcagaacattgaacaggggctggaggcttgccttgccggtctgctggtttctattctgttcatgatcatcttctataagaagtttggtctgattgcgaccagtgctctgattgccaacttgatcttaatcgtcggcattatgtcgctgttgccaggcgcaacgctgagtatgccaggtatcgcgggtatcgtcttaacccttgcggtggcggtcgatgcgaacgtactgatcaacgaacgtattaaagaagagttgagcaacggacgtactgttcaacaggcaattgatgaaggttatcgtggcgcattcagttctatcttcgatgcgaacatcaccacgctgattaaagtcatcatcctgtacgcagtgggtaccggggcaattaaagggttcgcgattactaccggtatcggtgtggcgacgtcgatgtttaccgcgattgtcggtacgcgtgccatcgtaaacctgctatatggcggcaagcgcgtcaagaagctgtcaatctgaggagtgcgatgtggcacaggaatatactgttgaacaactaaaccacggccgtaaagtctatgactttatgcgctgggactactgggctttcggcatctctggtctgctgttaatcgccgctatcgttattatgggcgtgcgcggctttaactgggggctggatttcaccggtggtacggttatcgaaattacgctcgaaaaaccggctgaaattgacgtaatgcgtgatgcattgcaaaaagccggttttgaagagccaatgctgcaaaactttggtagcagccacgacatcatggtccgtatgccgcctgctgaaggcgaaaccggcggtcaggtgctgggcagccaggttctgaaggtgattaacgaatccaccaatcagaatgcagcagtgaagcgtattgagttcgtcggtccgagcgtgggggcagaccttgcgcaaaccggtgcgatggcgttgatggcggcgctgctgtctatccttgtgtacgtaggttttcgctttgagtggcgactggcggcaggggtcgttattgcgctggcgcacgacgttatcattacgctgggtattttgtcgttattccatatcgagattgacctgaccattgtggcatcgttgatgtcggttatcggttactcgcttaacgacagtatcgtggtatcggaccgtattcgtgaaaacttccgcaagatccgtcgcggtacgccttacgaaatctttaacgtgtccttgacccagacgctgcaccgtaccttgatcacatccggtactaccttgatggttatcctgatgctgtacctcttcggtggtccggtactggaaggcttctcgctgaccatgcttatcggtgtttccatcggtactgcatcttccatctatgtggcatctgcgttggctctgaaactgggtatgaagcgcgaacacatgttgcagcagaaagtggaaaaagaaggggcggatcagccgtcaattctgccttaatcaagttcccgttgatgttgaaaatcccggtcagaagatcgggattttttttgatgtatggagattgcgaaaatccccgcatcttgggaaactgcgcgtaaccctacatttcatccaggtaacttttcatggctatcatcccaaaaaactatgcgcggttagaaagcggctatcgcgaaaaagcattaaaaatctatccgtgggtctgcggtcgctgttcccgcgagtttgtctattccaacctgcgtgaacttactgttcaccacattgatcacgaccataccaataacccggaagatggcagtaactgggaattgctttgtctctattgccacgatcatgagcattcgaaatataccgaagcggatcagtatggtacgaccgttatcgcaggggaagatgcgcagaaagatgtcggtgaagcgaagtacaacccattcgctgacctgaaagcgatgatgaacaagaagaagtgattaaaacgtaaaattgcctgatgcgctacgcttatcaggactacgttatttcagcaatatattgaatttacgtgcttttgtgggtcggacaaagcgtttacgccgcatccggcatgaacaaagcgcacgttgttaacaatctgaaatgccgggaataaatcccggcattttcataatcagaagttgtaacctacaaccaggtaaccaccccagccggtagagcgaacgttgaagttgccgttgccgaagttcagttctgcatcgtcgttccactgaccaccgtcgtgccagtaacgagctacgacagagtagtgccagtgatcgtagttcagagccagaatatggctggaagcgatagagttattagtacgggtcttaataccgttgattgcgttaccgctgtcatcccctaaatcggaaccccagtcgaagttggtgaagccgatgtagctcagctgaccgccccacagatcggtaatcggcacaaagtatttaattttgaaacggtaaccgtcccactcgttttcgttcgctgcgccatagttctgccactggtatttcgcatagacgttcatggacaggctcatcggcagaccagtatcgatgtcggtacccagacccatataccaggtgctctggcgaccatctttattacgacccatgtcgtaaatgtagttgttcgcgaagtaccactctttgaacggaccgaagctaaggtcagtattggtcagcttgtcgatggagaaacgtggttcgatttccataaacagcggagagccgtggttccagatacctttggcatcggagttaccgccgaagaataccggcgcatccgcataaccatagaagtcgaaccagtcttttttagcgaatgcttcgtactcaaggtaggtatcgttgcggatctgcggtccaaaacgggtgtgatagcttccgacaacgttaacgctctggtgccaccagtcggaaagatactgcggtttgtcgttttcagctgcgttgacagtaaaagacgaagagagcgccagtaccgcaccggctgccagtaatgtttttttcatatgtatgccactgtttgaaaatcccttgcgggagtgaaaaaggcgcaaattgcgtttctaaatatttcgtatacagaggagcctattataaaaatcattgctcacaaaaatatgtttcgtttcacagttctatcatttacgtaatcgattgcgttcacgtttacacacattcgggcagggattgtactgactttcacccttgttgcaaacttttactatcaatctgggtgatgtaagcggagtaacaaaatgacggggaaagatgttgcgggacgcacaaaatcgccccgaaatacgtttactgcataacaggttgaatatcgtggatacgtacgaagtctaactgttctacagaaataccctttaactgtaacggaatatcaacatcgctgggggcgaggacgctggcaggggcattaatcaattgattctgcacattgatttcctgaaagttgtctattgttccctgaatttgcccatattcaacagttccgctgaatgcgggcaagggatcattcgactcgccctgaatacgtagcgtcagggtggtgccatctgcatcaggcgtaatattcaccagcgacatacgtaaagtaccgatctggctttccagtcttgccggtgttttcgctccaggcagaaggtaaaccccactgctggattttgcattcagcctgttttgctgagtgattttgaccgtttctttattgagttgcgtcatctcctggttcagcgtgctgacgctgtgtttcatctgtcgcacttcgctctgctgcacacaggcgctaaggctgaacaggcttcccagcaggagcagtcgaaaaacgttagtattcataggtcgtccctttctcgtcgcaattagcctaatggtagagggtaaaagcagcgaaagcatcgatcctttatctcaaaagcgttgcgcctttgttgtatcgtcagttcagggtaaaatagatttctgttaaccacctggtcaggacgccgtatgcattgcccattctgtttcgccgtggacactaaggtaattgactctcgtctcgtgggcgagggttcatccgtacgccgccgtcggcagtgtctggtgtgtaatgaacgtttcaccacctttgaagtggcggagctggttatgccgcgtgttgtaaaaagcaacgacgtgcgtgaaccgtttaatgaagagaaattgcgtagcggaatgctgcgggcgctggaaaaacgtccggtgagttccgatgacgtcgaaatggcaatcaatcatattaaatcgcagctgcgcgccaccggtgagcgcgaagtaccgagcaagatgattggcaatctggtgatggagcaattgaaaaagctcgataaagtcgcctatatccgttttgcctctgtctaccgcagtttcgaagatatcaaagaatttggcgaagagatcgcgcgcctggaggactaagccgtgcaggacgagtattacatggcgcgggcgctaaagctggcgcaacgaggacgttttaccacgcatcccaacccgaatgtcgggtgcgtcattgtcaaagatggcgaaattgtcggtgaaggttaccaccaacgtgcgggtgaaccacatgccgaagtacacgcgttgcgtatggcgggtgaaaaagccaaaggtgcgaccgcctatgtcacactcgaaccctgtagccatcatggtcgtacgccaccgtgctgtgacgcactcatcgccgctggcgtagcgcgcgtggttgcctcgatgcaagatcctaacccgcaggtcgctgggcgtggactttaccgtctgcaacaggctggcattgacgtcagccacgggctgatgatgagtgaagccgagcaattgaataaaggctttctcaagcggatgcgcaccggctttccttatattcagttaaaacttggcgcatcgcttgatggccgcacggcgatggcgagcggcgaaagccagtggatcacttcgcctcaggcgcggcgcgacgtacaacgacagcgcgcacaaagtcatgccattttaaccagcagcgccacggtgctggcggatgatccagccttaacagtgcgttggtctgaactggatgaacaaactcaggcgctctacccgcaacaaaatctccgccagccagtacgtattgtgattgatagccaaaatcgcgtgacgccggaacatcgcattgtgcagcagcccggcgaaacctggttcgcgcgtacgcaggaagattctagtgagtggccggaaacggtgcgtaccttgctgactccagagcataaaggtcatctggatctggttgtactgatgatgcaactgggtaaacagcaaattaacagcatctgggtggaagcggggccaacgctcgctggcgcattgctgcaggcgggtttagtcgatgagctgattgtctatatcgcacctaaactattaggcagcgacgcccgcggattatgcacgctgccagggcttgagaaattagccgacgccccccaatttaaattcaaagagatacgtcatgtaggcccggatgtttgcctgcatttagtgggtgcatgatctcccggctcgaaagggaagcagcgcacgaaatattatgctaaaatccgcccccctgcggggccatactcgaacccgaaggaagaaaatgaacattattgaagctaacgttgctaccccggacgctcgcgtcgccatcaccatcgcgcgtttcaacaactttatcaatgacagcctgctggaaggtgcaattgacgcactgaaacgtatcggtcaggtaaaagatgaaaacattaccgttgtttgggtgcctggtgcctatgagctgccgctggcggcgggtgcactggctaaaaccggtaaatacgacgcggtgattgcgctgggtacggttattcgtggtggcactgcccactttgaatatgtcgctggtggtgcaagcaacggcctggcgcatgttgcccaggacagcgaaattccggttgcttttggggttctgaccactgaaagcattgaacaagcgatcgaacgtgctggcaccaaagctggcaacaaaggtgcagaagctgcactgaccgcgcttgaaatgattaatgtattgaaagccatcaaggcctgaaattagtaaggggaaatccgtgaaacctgctgctcgtcgccgcgctcgtgagtgtgccgtccaggcgctctactcctggcagttgtcccagaacgacatcgctgatgttgaataccagttcctggctgaacaggatgtaaaagacgttgacgtcctgtacttccgtgagctgctggccggggtggcgactaacaccgcatacctcgacggactgatgaagccatacctgtcccgcctgctggaagaactgggacaggtagaaaaagcagtactgcgcattgcgctgtacgagctgtctaaacgtagcgatgtgccatacaaagtggccattaacgaagcgatcgaactggcgaaatcgttcggcgcagaagacagccataagttcgtcaacggcgtactcgataaagcagcacctgtgattcgccctaacaaaaagtgatatccaggccggtagattcacggaagaccgttccgcgatcgccggccttttcttttttacctgctgaggcataacgtatggcatgtggcgagttctccctgattgcccgttattttgaccgtgtaagaagttctcgtcttgatgtcgaactgggcatcggcgacgattgcgctcttctcaatatccccgagaaacagaccctggcgatcagcactgatacgctggtggcgggcaaccacttcctccatgatatcgatcctgctgatctggcgtataaagcactggcggtgaacctaagcgatctggcagcgatgggggccgatccggcctggctgacgctggcattaaccttaccggacgtagacgaagcgtggcttgagtccttcagcgacagtttgtttgatcttctcaattattacgatatgcaactcattggcggcgataccacgcgtgggccattatcaatgacgttgggtatccacggctttgttccgatgggacgagccttaacgcgctctggagcgaaaccgggtgactggatctatgtgaccggtacaccgggcgatagcgccgccgggctggcgattttgcaaaaccgtttgcaggttgccgatgctaaagatgcggactacttgatcaaacgtcatctccgtccatcgccgcgtattttacagggacaggcactgcgcgatctggcaaattcagctatcgatctctctgacggtctgatttccgatctcgggcatatcgtgaaagccagcgactgcggcgcacgtattgacctggcattgctgccgttttctgatgcgctttctcgccatgttgaaccggaacaggcgctgcgctgggcgctctctggcggtgaagattacgagttgtgtttcactgtgccggaactgaaccgtggcgcgctggatgtggctctcggacacctgggcgtaccgtttacctgtatcgggcaaatgaccgccgatatcgaagggctttgttttattcgtgacggcgaacctgtcacgtttgactggaaaggatatgaccattttgccacgccataaagatgtcgcgaaaagtcgcctgaagatgagtaatccgtggcatctgcttgctgtcggattcggaagtggattaagcccaatcgttcctggcacgatgggatcgctggcagcgattccgttctggtatctgatgacctttttaccctggcagctctactcgctggtggtgatgttggggatctgtatcggcgtctatctttgtcatcaaacggcgaaagatatgggcgtgcacgatcacggcagcattgtctgggacgaatttattggtatgtggatcacgctcatggcgctgccgaccaatgactggcagtgggttgccgccgggtttgtgattttccgtattctggatatgtggaagccgtggccgatccgctggtttgatcgcaatgtacatggcggcatggggatcatgatcgacgatattgtcgccggggtgatttccgcaggcatcctgtactttatcggtcatcactggccgctgggtattctgtcgtagttgtgcaccgatgcctgatgtgacgcttgtcacgtctcatcaggcctggactcttatttaaatcctacgaccgcatgcggtttatacggcgtttccagttcggcaatctgttctggcttcaaagtgatatccaccgcgttcagcagctcatcaagctgttcttcccgcgatgtaccgataatcggtgcggcaatgcccggtttactcaacaaccaggccagcgcaacttgtgctcgtgttgcaccgagttcttcactgacgcccgttaaccgctctgcgatctgcgcgtcattttcatcgctttctttatagagatttctccccacctcatcagacaccagtcgtgcggtagtttctccccacggacgcgtcagtcgcccccgcgccagcgggctccacggaatcaccgccacgccctcctgataacacagaggcagcatctcgcgctcttcttcgcgataaatcagattgtagtgatcctgcatactgataaactgcgcccagccgtgctgtttttgtagcttcagggcctgagcaaactgcgaagcgtgcatggatgacgcgccgatataacgcgctttcccggcttttaccacgtcgttcagggcttccagcgtctcttcgatcggcgtgttgtaatcccagcgatgaatttgcaggatatcgacataatccatgccgagacggcgcaggctgtcgtcgatagagcgcaaaatttgtgcacgggataatccttccggtaaatcaccaacgcgatggaacactttcgtcgcaacgaccacgtcttcacgacgggcgaaatcccgcagtgcgcgaccaacgatctcttcgctgctgccatcggaatagctattggcggtatcaaagaaatttatgccgccttccagcgcgcgtttaatgatgggacggctactctcttccggcagtgtccatgcgtgattaccacgatctggctcgccaaaggtcatacagccgaggcaaagtcgggaaacgcgaaggtcggtttttcctaaggggttgtattgcatgctgccactcctgccatactcgtcatacttcaagttgcatgtgctgcggctgcattcgttcaccccagtcacttacttatgtaagctcctggggcttcactcgtttgccgccttcctgcaactcgaattatttagagtctatgaataatttgttaagcatagcaggagtggagtagggattatgccagccaggccttgattttggcttccataccggcggcatcgaggccgagttcggcgcgcatttcttcctgagttccttgcggaataaagaagtcaggcaggccaatgttcagcacgggtactggtttacgatgggccattagcacttcgttcacgccgctgcctgcgccgcccataatggcgttttcttctacggtgaccagcgcttcatggctggcggccatttccagaattaacgcttcatcaagcggtttcacaaaacgcatatcgaccagcgtagcgttcagcgattcagcgactttcgccgcgtctggcatcagcgtaccaaagttaaggatcgccagtttctcgccacgacgcttcacaatgcctttgccaattggcagtttttccagcggcgtcagttccacgccaaccgcgttaccgcgcgggtagcgcaccgcggacgggccgtcgttatagtgatagccggtatagagcatctggcgacattcgttttcatcgctcggggtcataatgaccatttccggtatgcagcgcaggtaagagaggtcaaaagcgccctgatgggtttgaccgtcagcaccaacaatgcccgcgcggtcgatggcgaacaggaccgggagcttttgaatcgccacgtcatgcagcacctgatcataggcgcgttgcaggaaagtggagtaaatcgcgacaatgggtttgtacccaccaatcgccagaccggcggcaaaggtcaccgcgtgttgctcggcgattgccacgtcgaagtaacgatccgggaatttacgtgaaaactcgaccatgccggaaccttcacgcatcgccggagtaatcgccatcagcttgttgtctttcgctgccgtttcgcacaaccagtcgccaaagatttttgaatagctcggcaaaccgccgctacttttcggcaaacaaccgctggagggatcaaatttaggcacggcgtggaaagtgatggggtctttttctgccggttcataaccacgaccttttttggtcatgatatgcaggaactgcgggcctttcaggtcgcgcatgttcttcagcgtggtgataagccccagcacatcgtgaccgtcaaccgggccgatgtagttaaagcccagctcttcaaacaacgtgccaggcactaccatgcctttaatatgttcttcggtacgtttgagcagctctttaattggcggaacgccagagaaaacttttttcccgccttcgcgcagtgaagagtaaagcttaccggaaagcagctgcgccagatggttgttgagcgcgccgacattttcggaaatcgacatttcgttgtcgttgaggaccaccagcatatcaggacggatatcgcccgcgtgattcatcgcttcaaacgccatgcctgcggtaatcgcgccatcgccgattacacagacggtacggcgatttttgccttctttctcggcagcaaccgcaataccaattccggcactgatggaggttgatgaatgcccgacgcttaatacgtcatattcgctttcgccgcgccacgggaacgggtgcaggccgcctttctgacggatggtgccgattttgtcgcggcgtccggtcaaaattttatgcggataagcctgatgccccacatcccaaatcaattggtcaaacggggtgttgtagacatagtgcagcgccacggtcagttcgaccgtgcccagcccggaggcgaagtgcccgctggaacggctcacgctgtcgagtaaatagcggcgcagttcgtcgcagagtttcggtaaactctctttcggcaacagtcgtaactcctgggtggagtcgaccagtgccagggtcgggtatttggcaatatcaaaactcatcaggggcctattaatacttattgtttatttattacgctggatgatgtagtccgctagcgcttccagtgccgaggtatcgagtgattgttcagccagttgtttcagcgactgacgggcatcgtcgatcagatcccgggctttcttccgggcttgctcaagacccagaagtgcagggtaggtacttttaccaagttgctggtcggcaccctggcgttttcccaacgttgcagtatctcctaccacatccaggatgtcatcctgaacctggaaggcaaggccgatgctctctgcgtacttgtcgagtactggcagagcacgacgccctttatctccggcgcttaatgcaccaaggcgaacggcggcgcgaatcaatgcgccggttttatgacgatgaatacgctcaagcgcgtccagaggtacgtgtttgccttccgcgtctaaatctaatgcctgaccaccgcacattccggcaataccgctggcgctcgccagttcagaaatcatcgaaattctgtcgcgatccgacacttccggcatattggcatcgcttagaatcgagaacgccagcgtttgtaaagcgtcgccagcgagaatcgcgtttgcttcgccaaacttcacatggcaggtcggcaaaccgcgacgcagatcgtcatcatccatcgccggtaaatcatcatgaattaatgagtaagcgtggatacactctacggcggcagcgggtgcgtccagcgtgtttgtgctaacgccaaacatatgaccggtggcataaaccaggaagggtcgcagacgcttaccacctaataatgcgccatactgcatggtttcgaccacgggagtgttctgaaagggcagtggggcgataaaacggctcagcgcctggttggcctgcttaacgcaggcttcgagttgctgcggaaagtccattactcattgtccggtgtaaaaggggttagagaggcgtcttcattgtcagacagcagaatttgtacgcgctgttcggcttgttgtaatttggcctgcccctgacgtgccagctgcacgccgcgttcgaactcgttcagcgcctcttccagcggcaggtcgccactttccagacgggttacaatctgttccagctcgctcagcgccttttcaaagctggcgggagcctcatttttcttcggcataatgaatgtctgactctcaatatttttcgccccgtcatggtaacggactcagggcaaatagcaaataacgcgcaatggtaaggtgatgtgcgcagcaaagcgatgttagtggtatacttccgcgcctggatgcagccgcaggtgtgggctgctgtatttttccctatacaagtcgcttaaggcttgccaacgaaccattgccgccatgaagtttatcattaaattgttcccggaaatcaccatcaaaagccaatctgtgcgcttgcgctttataaaaatccttaccgggaacattcgtaacgttttaaagcactatgatgagacgctcgctgtcgtccgccactgggataacatcgaagttcgcgcaaaagatgaaaaccagcgtctggctattcgcgacgccctgacccgtattccgggtatccaccatattctcgaagtcgaagacgtgccgtttaccgacatgcacgatatttttgagaaagcgttggttcagtatcgcgatcagctggaaggcaaaaccttctgcgtacgcgtgaagcgtcgtggcaaacatgattttagctcgattgatgtggaacgttacgtcggcggcggtttaaatcagcatattgagtccgcgcgcgtgaagctgaccaatccggaagtgactgtccatctggaagtggaagacgatcgtctcctgctgattaaaggccgctacgaaggtattggcggtttcccgatcggcacccaggaagacgtgctgtcgctcatttccggtggtttcgactccggtgtttccagttatatgttgatgcgtcgcggctgccgcgtgcattactgtttctttaaccttggcggcgcggcgcatgaaattggcgtgcgtcaggtggcgcattatctgtggaaccgttttggcagctcccaccgcgtgcgttttgtcgctattaatttcgaaccggtcgttggggaaattctcgagaaaatcgacgacggtcagatgggcgttatcctcaaacgtatgatggtgcgtgccgcgtctaaagtggctgaacgttacggcgtacaggcgctggtcaccggcgaagcgctcggccaggtgtccagtcagacgctgaccaacctgcgcctgattgataacgtctctgacacgctgatcctgcgtccgctgatttcttacgacaaagagcacatcatcaacctggcccgccagattggcactgaagactttgctcgcacgatgccagaatattgtggcgtgatctccaaaagcccgacggtgaaagcggttaaatcgaagattgaagcggaagaagagaagttcgacttcagtattctcgataaagtggttgaggaagcgaataacgttgatatccgcgaaatcgcccagcagaccgagcaggaagtggtggaagtggaaaccgtcaatggctttggcccgaacgacgtgatcctcgatatccgttctgtcgatgagcaggaagataagccgctgaaggttgaaggtatcgacgtggtttctctgccgttctataaactgagcaccaaatttggcgatctcgaccagaacagaacctggctactgtggtgtgagcgcggggtgatgagccgtctgcaggcgctctatctgcgcgagcagggctttaacaatgtgaaggtgtatcgcccataatttgtggtttttacgtcgcatctggtcagatgcgacgtttgccgcatccgacactactcgtaataattataaatccctgccgccatcaccagttgtgatgccacttcatgggctttctcgcgcccaaccagcaggtcgataattttcagaccaaaatcaatagccgtacccggcccctggctggtcagcaattttacccgtgcatcccagacgacgcgcttgtcctgccattgttcggcgggaattttgtctttcagcgtcgggaagccggtcatattgccaatcgggaagatatcgtgcggtaccagcacggtggctggcgcggcgcaaatagccgcgacgatacgcccggaacggtggaactgtttaacggtttcaaccagcagggtactatcgcgaaaacactctgcgcctttaatgccaccaggcagtacgatcacgtcatattcgccatcagccacctcgaccagcggcgcatccgccagcagcttcacgccgcgcgagcaggtaatggccaggttgccatcgctggcgacgctggcagtggtgactttgataccgccgcgaaccagcagatcgatagtggtgacggcttcagtctcttcactaccaggggcgaggcaaaccagtgccgatgcgctcatattcactctcctttctttttaccatttcaaacaggcgggtgttttccggtacggcaatcccatgcgcgcgggcgcggcgtaagagaaaaccattgatatagtcgatttcggtgtggcgcagcgcgcggatatcctgcaacatcgacgagatattttccgctgtggcatcaatcacctgcatcacgtaatcacgcaaatcttctgctgaagtatgatgcccttcgcgctcgatcactgccgcgacttcttcgcatatctgcataatttcttgcggatgatgacgtaattcaccattcgggcaattccagatggcggtcagtggattaatcacacagttgacggccagcttgcgccacagctcggcgcgaatattgttatgccaggcaacgtcaggcaacacggtttgcaaaatatccgccagataactgtaatcgccatcctgttgccgtgccggaccaatatgcgtgattccgtttgccacatgaataatgacattgccgtcgcggcgggcggcatgggtggtggtgcccatcagtaatggctgctgaatgttttgcaactcttcgatggtgcccatgccgttgtgaattaacagtattggcgtggttacaggcagtgtggacgcgaggcttttgacggcatcgtaaacctgccatgctttcagcgtcaccaggagcagatcgctggtggcaagaaaatcgggatcgttggcggtcagcgattcgttaaatatcgaaccatcagtctcaaccagattcacactacaataaggttgcggtacgcgcagccagccctgaacttcgtgaccctgtttacaaagtgctgtaagccataattgccctaaggcaccgcatcccaatacggtaattttcattgttcctcctcacccgcaaccactccgggtgttcaataaggctatcccttaattgtgcatgctgttgcgactatgcacaattaagggatacgtcctggtgcaggactgttggttatttaactttgcaggtattatgcttcgcatcaaaaatgaagggagaggaaaagatgccatctttcgatattgtctctgaagttgatcttcaggaagcacgtaacgcggtcgataacgcgagtcgcgaagtggagtcccgttttgacttccgtaacgttgaagcctcatttgagctgaacgacgccagcaaaaccatcaaagtgttgagcgagtccgacttccaggtcaatcagttgctggatattctgcgtgccaagctgctgaagcgcggcattgaaggcagttcactggatgtaccggaaaatatcgttcatagcggtaaaacctggtttgtggaagcgaaactgaaacagggcattgagagcgcgacccagaagaaaatcgtcaagatgattaaagacagcaaactgaaagtgcaggcgcaaattcagggcgatgagatccgtgtgactggcaaatctcgtgatgatttgcaggctgtcatggcgatggtacgtggtggcgatcttggccagccgttccagttcaaaaacttccgcgattaatcgcgacaatgtgcgttttgttcatgtcagatgcggcatgaacgcctgattcggcctacaacggtttgtaactcaagaactttgtaggcctggtaagcgtagcgcagcaggcaattcgccgcgttttttatgcctgacgaattgcctgttcaacctcaaagcgatttgtcactttgctgtcgattttcacataagctgaatgctcttcttctgcaatcaacacttctttgacgccttcagtttccagcaaacgcacttttaacgcttcgtttgcggcaatgtccgccgggatttcaatgcgcaaactgctgacatacggcggttctttcatggtactggcgactgccagccacactgcggccagcattgcgccagcgagaaataccccctgaccgtcaaacatgccgtcaatccagccgcccagcgaaccgccaatcgccacgccaagaaactggctggtggagtagacacccatcgccgtacctttgtaacctgctggcgactctttactgataagtgagggcagaagggcttccatcaaattaaacgccacaaagaaaagctgcacgccgaccaccagttgccagaactgcgtttgtgcgttccacaacacaatttccgcaaccacgatcaacccgacgcagaagacaaagacttgcttcattttgcgcttaacttcagcgtagataatgaaaggcacgaccgagccaaaggcgattaacatcgtcgccagatagaccttccagtgttcagccgccgggaaccccgcatcagctagctgtccgggcagggcaacaaacgtagacatcagaagcatgtgcagacacataatgccaaagttgagtttcagcagccgcggttccgccagcactttactgaaactgcctttcaccattccggactcacgattaagtacgtgagtgctactgttgggcacaacccaaatggtcaacgcaatgccggttgttgccagaatagcgatcatccagaacagcgcgtgcagcccaagtttgtgagtgatgatcgggccaagcaccatcgcaatggcaaaggtaatgccaaagctcacgccgataaacgccatcgctttggtgcggttttgttcgcgcgtgagatcggaaagcagcgccataacggcggcggcaattgctccagagccttgtagcgcccggcccagaataattccccagatggagtcggaaagcgcagcgataacgctaccggcggcaaacaccgccagcccaccgacaattaatggtttgcgaccaatgcggtcggaaagcaggccaaacggaatctgaaaaacggcctgagtcagaccataaataccaatggcaataccgattaatgcttcgctggcaccttgcagagccatgccgtacgtggtcagaaccggcagaaccataaacatgcccagcatgcgcaacgagaatacggtccctaaaccccaggtcgcgcgcctctcacctggcgtcattttataatcgttcattaccaccccttaaaaaaatgcccacatagtgtagtgcggagcgcatgttgggtaaacagagtgttaatgagaaaatattacagaggagagtaatttgtgtgtcaggtatgtttttttgcattcataaaatgaatgctctatatgttgaaaaaatgaattttaaaactaaatagttttacatcaaaaaagtaataatatcatttcttgattgctatgtgcattttttatcttacgaatatgctagttttatctcactaaataaacgatttggtgacatggatgataatgtttcaggctaaatgtgtgcttattacttggacctttatggcactgtatttattcattaaatggatatttggtggttaattattatggaaatatatgacagtgaggacataaaggtatacatgttaactaaaagaatattattttctgtaatgctgatagtttcaccaagcgtggtggccagcgagaaagcgcatgaattgtatgacagcatatacggtggtaaacctgctcccgatgttataaatacactgcataaaatggctgaatcgggagatatcgacgcgcagagcctgttaggctgggaatattatcagcctcgttatgataccaaacctgatgttcaggaagcgattaaatggttcgagttagcggctaaacaaggtgacagagaagctccgttagcgctggggggtatctactacgacggtgagcaggtgcgggtggattatgccaaagcgtatgcactatttaatcaggccgcgcagcacggtgtgaatttagcatggtccaggttgggcattatgtacgccaatggtcagtatgttgaggtagattgtaagaaagcgaaggaatatcttgataaaggtgtccacatttatggtggcccagaagactttctggctacttgtcgaaaagacatgattgacagaaaaacggttgacgatacgttacccgtgattacggttacccgttctgggatgcgagataattttttagataaaggtttttcctgcatggatagcctcttcgccaccaccaataaattaggcgaagtggccaatcttcgcgtgacattcagcattcgtcgcccatccggtaaggagattaaccaaacggttggcttcgcgcctttcggtttaaaccggctgaatattagctttactgattacctatttggttcatttaccagtaattcgtctcttattctttataaaccggaatttgagcgaaaatcttgtgcaactgtaaggaccacaatcgttgccgcaacggcaaccattaacggcaaggatgtggagttgctgaaaacgggggcaattgaacaaaagtggtaacgctgctcagcccccggctgaggcaaaacttgccctggcgggtggcgataataatctaagccgcgagaatatgctgaatcgccaaaaacataggtacagcaccaaaagcatttggtgtcgctgaaagctgaacaaagccgagacgagcataaaaattaatggcggcagggtcagcatcaagataaacccctttaattggtaatgcctggtgaattatttttacatgttcaaaaaaatcacatagtaggtcctgaccaaagccccgcttttgatacttccgtgctacccccaacatgactaatctgacaacaccaatttctgaaggttgtgaaccctgaaggacgccagaaacgcgttgtttttccagcgaatatgccgtaaaagtacagatgccgatcagttcaccactttgtctgtcaataagtgctttagccgcacagtcgctattacgcacacttttctttagcgatgcgcgtacaaatttatcgataacagggttaccgcaatcaaactgtttttgcccaggataagtaatatcagactgataattacaggagaggactatgggcagagtaatctcttcatgcttgtcgaccatcgctgtttttccttttcattaacgccttgagggcgagcgtcggttgagcaggttcagcgatgagttggttcatcagttcccagctttgattcgaaagctcacggcgacgttggttatcaagcacactttcggcgcgttccatagcagcgctcaaaataaaagcgcttaaatctaccccaacggcttgcgcagcttcacgaagtttgtttttggcgtcgggactagttttgagttcgacccgcgcatttttcagcgttttatcgacatcgggtagagtggctgtttttccaggcattatgacctctttgattaactgaatgaaatcgtagggagtcgatctcatacataatacggctatcaaccgtatgattaatttatgttcatctgctcactctgtcaagacatacggttattagccgtatctctgatctcagacaataaaaaaggtgccgtagcacctttttaatagagaggttttgttaccacacagcagccagcagcgtatgcgagtccggtaccataaaatcaacggacatcatcaccgagagggcagtgatggcgatgatagagaagccgaacagcttgcgcgcccagattctgtcatcagcaactttataaccgcgcagagccatacctaaccaccagacgctaaccgccgcggcgaccaccagatatttatatccagcgtaaccgccaagagagagcatcagcgtggcaacggcaaaggcgatgatatacagcgtgatgtgattcttcgccaccgaaatgccttttaccactggcaataccggaatgtttgccgcctggtaatccttaaagcggaaaatggcgatggcataggagtgaggcatctgccacaggctgaagatagccagcaggatcgctgcgccgctatcgaactcgccggttactgcacagtagccaatcaccggcggcgcagcgccggagagcgaaccaatcaatgtgccgtagactgagtggcgtttcatgtacaggctatagacgccgacataaaccacaaagcccatcacccccagccagcaggccagcggattcgcgccaaaccacagcagcataaagccagcaatacccagcaaggtggcgtacaccagcgagacagcaggagagatcaggcctttaaccagcacccgattcttcgtcctttccatctttctgtcgatatccctgtcgatgtagttgttaaacacacaacccgacgccacaaccagtgacaccccaaccagcgtgtagataaacaggggataatcaatgctgccctttgaggccagcaggaatcccccaatcaccgagatcaggttgccaaagatgatgcctggtttcgttacttgcaggtattgcttaaacatcataaccgccgctcttagtgcatcatcatgttgtagttgaggttccacataatccagatggagcctacaaccaggatagcgatgattagcacggtgaagacaaacgccgtcatgttccagccttcatctgatttggtattcatgtgcaggaagcacaccagatgcaccagaacctgtaccactgccattgccaggattgttcccagaattacggccggagaggcagcccctgtcatcaccatccagaacggaatcaccgtcagaatgatcgacaggataaagcctgtcatgtaggtttttacgctgccatgggacgcgccgctgtgatcggtagaatgactcattacatcgcccccatcagataaacaacagtgaacacacagatccaaaccacatccaggaagtgccagaacaggctcaggcacatgatgcgggtacggttagtgctggtcaggccgcgacgagcgatttgtaccatcagcaccgccatccagataagaccggaagtgacgtgcagaccgtgcgtgccgaccagcgcaaagaacgctgacaggaagccgctgcgatccggacccatgccgttaacaatcaggtgatggaattcgtagatttccatcccgataaatccggcaccaaacaaccaggtcaacgccagccaggagataacctggcttttgttgtttttgtacatggcgatagccgccatgccgtaggtgatggagctgaacaacagcaagaaagtttcaaccagaacgaacggcagttcgaaaatgtccttacctgtcgggccgcctgcggtgccgttcaccagaacggcataggtagcaaacaagattgagaacagaatgcagtcgctcatcaggtagatccaaaatccgaagattttggttccgcctgcatcgtggtgcccgtgttcgtgcgcgtgggcagtcgcgtgcgtcaaagtatcagttgccatttttcagccctgccttagtaatctcatcgaaatgctggttttccagtttttcgatttctgccaccggcacgtagtaatccacgtcctcgtcgaagcttttcacgatccaggtgatgatcatgcctgcgaagccaacaatcgccagccaccagatatgccagatcatggcgaaaccgaagatggtggagaaagctgcaatgacgatacctgcaccgctgtttttcggcatatgaatttcttcatagtggtcaggctttttatacgcttcgcctttctctttcatttcccagaatgcatcacgctcgtgaacgtgcggcacaacggcaaagttatagaacggaggcggggaagaggttgcccactccagcgtacggccaccccacgggtcgccagtcaggtcacggttctggtcgcggtcgcgaatagaaacgtacatctgaataacgaggcagagaatacccagcgcaatcagtactgcaccgctggctgcaatcatcagcatggtgtggaactgcgggtcaatctgctggctcaaacgacgggtcatgcccatgaagcccagcgcatacagcggcataaaggcaacgaagaagccgatgatccagaaccagaacgcgcgtttaccccaggtttcgttcagtttgaaaccgaacgctttaggccaccagtaggtcatccctgcgaagcagccgaagaccacgccgccgatgatcacgttatggaagtgcgcaatcaggaacaggctgttatgcagaacgaagtccgcgcccggtactgccagcagcacgccagtcatcccgcccaccgagaaagtgacgataaaaccgatggtccacagcatcgcagaatggaacacgatgcggccctgatacatggtgaacagccagttgaagatcttcaccccggtcgggatggcgataatcattgtggtgataccaaagaaggcgtttacgttcgcgcccgcacccatcgtaaagaagtggtgcagccaaacgatgaacgacagcacggtgatacagacggttgcccataccagcgaggtataaccaaacagacgtttacgcgagaaggttgccgcaatttcggagaacacaccgaaaacaggcaggatcaggatgtaaacttccgggtggccccaggcccaaatcaggttgatgtacatcatcatgttgccacccatatcgttggtaaagaaatgggtgcccagatagcgatccagggtcaacaacgcgacggtaaccgtcagaattgggaaggaagcaataatcagtacgttcgcgcacagtgatgcccaggtaaatactggcatcttgaacatggtcatgcccggtgcgcgcatcttcagaatggtaacgaagaagttgataccggtaagcgtcgtacctataccggatagctggagactccatatccagtaatcgacaccgactcccggactgtactctattcccgatagcggtggataggccagccagccggtctgcgcaaattcgcccacgccgagagaaacgttaaccagaatcacaccaacaacagtaaaccagaagcttaagttgttgaggaacgggaacgcaacgtcacgcgcgccgatctgcagcggaaccaccaggttcatcagaccgataacgaaaggcatcgccacgaagaagatcataatcacgccgtgcgcggtgaagatctgatcgtagtggtgaggtggcaggaagcccgcttcgcccgccgaggcaagagcctgctggctacgcatcataatggcgtcagcaaaaccacgcagcaacatcacaatcgccacgatgatatacatgataccgaggcgtttatggtcgacggaggtcagccactctttccacaggtaggtccacttaccgaagtaagtgatcaggccaacgagcgccagacctcccaaaataatgccagcgatcgtaaccatgacgataggttcatggaacgggactgcatcaagtgataattttccgaacatctttattcttcctcaacccctttaatgggcggattccgcgtggctcatgtccatgccttccataccttcgtgtgcactgtgctcaccttctggctgggtcatgtccatgctcttaccgtgagccataaacttgttaatcacatcggcaaacaagtctggtttcacgttggagaaatattccacctggttgtattcgctaggcgcggccagtttttcgaacgcagccatgtcagacatggtgttcggcgactgtttcgcttttgcgacccattggtcgaattcggcgcgatccggtgttgcaatagctttgaacttcatgcctgagaagcccggcccgctgtagctggcggagataccgtcataagtaccgggttcgttggcgatcagatgcaggcgagtctgcataccggccatggcataaatctggctacccagacgcggaatgaagaaggagttcatcacggagttggaggtcactttgaagtacaccggagtgttcgccgggaaagcgatttcattcacggtagcaatgccctgttccgggtagatgaagaaccatttccagtccatggaaaccacttcgatggtaatgggcttctcgtcgtgtgccagcggcttgctaggctcaagagcgtgagtggttttccaggtcagtaccgcaaggaagatgatgattaagataggtaccgtccagaccacagcttccactttattggagtgtgaccagttcgggctgtacttagcatctttattgctcgcacgatacttccaggcgaaaccaacagccatcaagattgcgggaataacgacaatcaacatcaggccaaatgccgtcagtatcagtgaacgttgctccagaccaatctgtcctttgggatctaacagcgcagaattacagccactgagcaatacagtgcctgcaaataatgacaaccatcccaaacttttattgtatttcctgagtctcatttaacgacctcaattccacgggatctggtggcgtttaaagtgtgtgggcattttacgggaaggttacattactgtaaacatgattaaattcctgttacttggatttggctgtcaggtcacatatgttgcaaaacatatcaagttgattttaagaagctgttgcaaaagggcgttataacgaaaggggagtgcagaaggagtttggacgggcaattggtataaccaatctggaataaaacaattgtttaacaaataattatcattatggtgacaattgggtggggggaaaataaagactcattagctgaatcgtgtaagaaaaaatagaattcataaattgcgtcaataatttccaaacgctaagccgcacaaaagaacaaatattattaagcgatactgatgtttatttagccgtaataattacggcgagtgattactacagctaaataatatttacagattacgtcagatgcgtttttcgtagcgccagataatccagcaaaccaccaagcacgacgccagaaagggcgactaaaaccccgacttccagcagagcaggcaggaaagagaagtgcgtcaaatccagcgcgtccatcgtcaacagcagtaaccacacggccaacaggctgacgcccgccgccagtgtccacatggcaaaggcataacctgccggatattcggtacgggagataaagttgtcatttactcgtgtatattcaagcgtctggcggcaaaccagcagcaaaataagccccggtacggcagcggcgacggagaatagatagaatgtcgaccagccgtgtgcttcaacaaaccaacccgccacggggccgacataaactcgtcctacagcggaaagcgctgagagcagggcaaattgagttgcggaaaatgacttattacacagcgtcattaacagcgcgacaaaggctgatgtgcccatcccgccacagaggttttcgaaaaagacggctgcgcccatgctgtagagatgcttatcagtaatcgacagcagccagtaaccagcgttagacgcaccttgtaaaatgccgaaaatcagcagcgcccggaacagcgacaggcgctgcatcaaaatcccaccgtacaatgcgcccacaatggtcgccagtaagccaagcgttttgttaaccacgcctacttcacccgcatcaaacccgacgccgcgaatcaaaaacgtggttgtcaggctcatggcgaatgcgtcgcccagcttatacagcacgataagaagcaaaataagccaggcattattgcgaccaaagaaatctcgcagaggtgcaacaaccgcttgttccagcgtttttggcacaggaatggtgtcggtcggttctggtgcaagcaacgtcgcgataatacaagggatcaacagcgccgccatcaaccagtacatgccctgccagcccagccatttatctgccagccacagggctaagccgccggaaaccagcatccctaaacggtaacccagcacgctgattgccgcgcccgcaccacgttcttctgccgggagcacatcggttttccacgcatcgaagacaatatcctgagaggccgagcaaaaagcgatcaccaccgccagcgccgccatccagcggagttgggtgcctggttcgagaaaacccatcgccgcaatggcgactaataacaggatttgcgtggcgagcagccaaccgcgccgccgcccaaaaaatgggggcgtgtagcggtccatcagcggtgaccagaggaatttaaaaacgtaagcctggcctaccagagagaagaaaccaatggttttgagatcaatattctcgaccgtcatccaggcctgtaaggtaccggatgtcagggcgagcggtagcccggaagcaaaacccaggatcagcaatatggctgaacgcggctgttgaaaaatacgtaaatattgactggacatgggcgtctacaggcccggcttgcaccgggccagagggcagaaattaacgcgcgttctgcttgatgaattcgtggatgctggtgtcctgagacatatcagcgatggtatcggtcagcacactgttaaccgcatcggcgatatttttgttggaggcctggaacgcaccttcaacgttgtagctggcacgatagtttttggtcattttgttgccattctgcgcggtagcgatgatggcgatatccgctttggtcgcgatgttgtagcgcacgttgccctgggacacgtcagcatacagttggctaacgatgatttgcagattaaccgggccattcggaccaaccatgtaaccacgcgcggtcatctgtttttccagcacttcttgcagcaggaaacgcagatcgcgggaggcggtcagggtaacgatttgattatcgcgggtgacttttgccagcgcctgatcggtacgctgatcggcaccattaatgcttacggtgacgcccatcaggcttggatcctgctgtggcagtgtaatcgtcggggaaacttcaatagttgttggcggttttgcgcatcctgcaagcataaacagagcaactaacgggaagaggatttttttgaacatgttcgggctctcagagactcttaagcgtgtttggtaaaaattcccgccatcataacattgccaacggcgaggggaagtgggtaaggcatgtaaattcatcatgttgacgaaataatcgcccctggtaaaagaaacactgatgcgaggcctgtgtttcaatctttaaatcagtaaacttcatacgcttgacggaaaaaccaggacgaaacctaaatatttgttgttaagctgcaatggaaacggtaaaagcggctagtatttaaagggatggatgacatctcagcgttgtcggaggagatatttcatgatgatacgtgagcggatagaagaaaaattaagggcggcgttccaacccgtattcctcgaagtagtggatgaaagctatcgtcacaatgtcccagccggctctgaaagccattttaaagttgtgctggtcagcgatcgttttacgggtgaacgttttctgaatcgtcatcgaatgatttacagtactttagcggaggaactctctactaccgttcatgcgctggctctgcatacttacactattaaggagtgggaagggttgcaggacaccgtctttgcctctcctccctgtcgtggagcaggaagcatcgcgtaaaaacgcatttgcaactgtcggcgcttttccagtatgttgctaaagattttatgaaaaacggcctgcgggccgttttgttttgtctggattttgcgctttttgcccagcattcagacgaaaattgcccgggaattgtgaaaaaatacgcgacagcgcgcaataaccgttctcgactcataaaagtgatgccgctataatgccgcgtcctatttgaatgctttcgggatgattctggtaacagggaatgtgattgattataagaacatcccggttccgcgaagccaacaacctgtgcttgcggggtaagagttgaccgagcactgtgattttttgaggtaacaagatgcaagtttcagttgaaaccactcaaggccttggccgccgtgtaacgattactatcgctgctgacagcatcgagaccgctgttaaaagcgagctggtcaacgttgcgaaaaaagtacgtattgacggcttccgcaaaggcaaagtgccaatgaatatcgttgctcagcgttatggcgcgtctgtacgccaggacgttctgggtgacctgatgagccgtaacttcattgacgccatcattaaagaaaaaatcaatccggctggcgcaccgacttatgttccgggcgaatacaagctgggtgaagacttcacttactctgtagagtttgaagtttatccggaagttgaactgcagggtctggaagcgatcgaagttgaaaaaccgatcgttgaagtgaccgacgctgacgttgacggcatgctggatactctgcgtaaacagcaggcgacctggaaagaaaaagacggcgctgttgaagcagaagaccgcgtaaccatcgacttcaccggttctgtagacggcgaagagttcgaaggcggtaaagcgtctgatttcgtactggcgatgggccagggtcgtatgatcccgggctttgaagacggtatcaaaggccacaaagctggcgaagagttcaccatcgacgtgaccttcccggaagaataccacgcagaaaacctgaaaggtaaagcagcgaaattcgctatcaacctgaagaaagttgaagagcgtgaactgccggaactgactgcagaattcatcaaacgtttcggcgttgaagatggttccgtagaaggtctgcgcgctgaagtgcgtaaaaacatggagcgcgagctgaagagcgccatccgtaaccgcgttaagtctcaggcgatcgaaggtctggtaaaagctaacgacatcgacgtaccggctgcgctgatcgacagcgaaatcgacgttctgcgtcgccaggctgcacagcgtttcggtggcaacgaaaaacaagctctggaactgccgcgcgaactgttcgaagaacaggctaaacgccgcgtagttgttggcctgctgctgggcgaagttatccgcaccaacgagctgaaagctgacgaagagcgcgtgaaaggcctgatcgaagagatggcttctgcgtacgaagatccgaaagaagttatcgagttctacagcaaaaacaaagaactgatggacaacatgcgcaatgttgctctggaagaacaggctgttgaagctgtactggcgaaagcgaaagtgactgaaaaagaaaccactttcaacgagctgatgaaccagcaggcgtaatttacgcagcataacgcgctaaattcgcacaaaggcccgtcaccgccaggtggtgggcttttttttgtcatgaattttgcatggaaccgtgcgaaaagcctctttcggtgttagcgtaacaacaaaagattgttatgcttgaaatatggtgatgccgtacccataacacagggactagctgataatccgtccataaggttacaatcggtacagcaggttttttcaattttatccaggagacggaaatgtcatacagcggcgaacgagataactttgcaccccatatggcgctggtgccgatggtcattgaacagacctcacgcggtgagcgctcttttgatatctattctcgtctacttaaggaacgcgtcatttttctgactggccaggttgaagaccacatggctaacctgattgtggcgcagatgctgttcctggaagcggaaaacccagaaaaagatatctatctgtacattaactccccaggcggggtgatcactgccgggatgtctatctatgacaccatgcagtttatcaagcctgatgtcagcaccatctgtatgggccaggcggcctcgatgggcgctttcttgctgaccgcaggggcaaaaggtaaacgtttttgcctgccgaattcgcgcgtgatgattcaccaaccgttgggcggctaccagggccaggcgaccgatatcgaaattcatgcccgtgaaattctgaaagttaaagggcgcatgaatgaacttatggcgcttcatacgggtcaatcattagaacagattgaacgtgataccgagcgcgatcgcttcctttccgcccctgaagcggtggaatacggtctggtcgattcgattctgacccatcgtaattgatgccagaggcgcaactgtgccgctatacttatccagggcggcacaacgctgtaagcggcttgcgcctgagaatggcatttgcgtcgtcgtgtgcggcacaaagaacaaagaagaggttttgacccatgacagataaacgcaaagatggctcaggcaaattgctgtattgctctttttgcggcaaaagccagcatgaagtgcgcaagctgattgccggtccatccgtgtatatctgcgacgaatgtgttgatttatgtaacgacatcattcgcgaagagattaaagaagttgcaccgcatcgtgaacgcagtgcgctaccgacgccgcatgaaattcgcaaccacctggacgattacgttatcggccaggaacaggcgaaaaaagtgctggcggtcgcggtatacaaccattacaaacgtctgcgcaacggcgataccagcaatggcgtcgagttgggcaaaagtaacattctgctgatcggtccgaccggttccggtaaaacgctgctggctgaaacgctggcgcgcctgctggatgttccgttcaccatggccgacgcgactacactgaccgaagccggttatgtgggtgaagacgttgaaaacatcattcagaagctgttgcagaaatgcgactacgatgtccagaaagcacagcgtggtattgtctacatcgatgaaatcgacaagatttctcgtaagtcagacaacccgtccattacccgagacgtttccggtgaaggcgtacagcaggcactgttgaaactgatcgaaggtacggtagctgctgttccaccgcaaggtgggcgtaaacatccgcagcaggaattcttgcaggttgatacctctaagatcctgtttatttgtggcggtgcgtttgccggtctggataaagtgatttcccatcgtgtagaaaccggctccggcattggttttggcgcgacggtaaaagcgaagtccgacaaagcaagcgaaggcgagctgctggcgcaggttgaaccggaagatctgatcaagtttggtctgatccctgagttcattggtcgtctgccggttgtcgcaacgttgaatgaactgagcgaagaagctctgattcagatcctcaaagagccgaaaaacgccctgaccaagcagtatcaggcgctgtttaatctggaaggcgtggatctggaattccgtgacgaggcgctggatgctatcgctaagaaagcgatggcgcgtaaaaccggtgcccgtggcctgcgttccatcgtagaagccgcactgctcgataccatgtacgatctgccgtccatggaagacgtcgaaaaagtggttatcgacgagtcggtaattgatggtcaaagcaaaccgttgctgatttatggcaagccggaagcgcaacaggcatctggtgaataattaaccattcccatacaattagttaaccaaaaaggggggattttatctcccctttaatttttcctctattctcggcgttgaatgtgggggaaacatccccatatactgacgtacatgttaatagatggcgtgaagcacagtcgtgtcatctgattacctggcggaaattaaactaagagagagctctatgaatcctgagcgttctgaacgcattgaaatccccgtattgccgctgcgcgatgtggtggtttatccgcacatggtcatccccttatttgtcgggcgggaaaaatctatccgttgtctggaagcggcgatggaccatgataaaaaaattatgctggtcgcgcagaaagaagcttcaacggatgagccgggtgtaaacgatcttttcaccgtcgggaccgtggcctctatattgcagatgctgaagctgcctgacggcaccgtcaaagtgctggtcgaggggttacagcgcgcgcgtatttctgcgctctctgacaatggcgaacacttttctgcgaaggcggagtatctggagtcgccgaccattgatgagcgagaacaggaagtgctggtgcgtactgcaatcagccagttcgaaggctacatcaagctgaacaaaaaaatcccaccagaagtgctgacgtcgttgaatagcatcgacgatccggcgcgtctggcggataccattgctgcacatatgccgctgaaactggctgacaaacagtccgttctggagatgtccgacgttaacgaacgtctggaatatctgatggcaatgatggaatcggaaatcgatctgctgcaggttgagaaacgcattcgcaaccgcgttaaaaagcagatggagaaatcccagcgtgagtactatctgaacgagcaaatgaaagctattcagaaagaactcggtgaaatggacgacgcgccggacgaaaacgaagccctgaagcgcaaaatcgacgcggcgaagatgccgaaagaagcaaaagagaaagcggaagcagagttgcagaagctgaaaatgatgtctccgatgtcggcagaagcgaccgtagtgcgtggttatatcgactggatggtacaggtgccgtggaatgcgcgtagcaaggtcaaaaaagacctgcgtcaggcgcaggaaatccttgataccgaccattatggtctggagcgcgtgaaagatcgaatccttgagtatcttgcggttcaaagccgtgtcaacaaaatcaagggaccgatcctctgcctggtagggccgccgggggtaggtaaaacctctcttggtcagtccattgccaaagccaccgggcgtaaatatgtccgtatggcgctgggcggcgtgcgtgatgaagcggaaatccgtggtcaccgccgtacttacatcggttctatgccgggtaaactgatccagaaaatggcgaaagtgggcgtgaaaaacccgctgttcctgctcgatgagatcgacaaaatgtcttctgacatgcgtggcgatccggcctctgcactgcttgaagtgctggatccagagcagaacgtagcgttcagcgaccactacctggaagtggattacgatctcagcgacgtgatgtttgtcgcgacgtcgaactccatgaacattccggcaccgctgctggatcgtatggaagtgattcgcctctccggttataccgaagatgaaaaactgaacatcgccaaacgtcacctgctgccgaagcagattgaacgtaatgcactgaaaaaaggtgagctgaccgtcgacgatagcgccattatcggcattattcgttactacacccgtgaggcgggcgtgcgtggtctggagcgtgaaatctccaaactgtgtcgcaaagcggttaagcagttactgctcgataagtcattaaaacatatcgaaattaacggcgataacctgcatgactatctcggtgttcagcgtttcgactatggtcgcgcggataacgaaaaccgtgtcggtcaggtaaccggtctggcgtggacggaagtgggcggtgacttgctgaccattgaaaccgcatgtgttccgggtaaaggcaaactgacctataccggttcgctcggcgaagtgatgcaggagtccattcaggcggcgttaacggtggttcgtgcgcgtgcggaaaaactggggatcaaccctgatttttacgaaaaacgcgacatccacgtccacgtaccggaaggtgcgacgccgaaagatggtccgagtgccggtattgctatgtgcaccgcgctggtttcttgcctgaccggtaacccggttcgtgccgatgtggcaatgaccggtgagatcactctgcgtggtcaggtactgccgatcggtggtttgaaagaaaaactcctggcagcgcatcgcggcgggattaaaacagtgttaattccgttcgaaaataaacgcgatctggaagagattcctgacaacgtaattgccgatctggacattcatcctgtgaagcgcattgaggaagttctgactctggcgctgcaaaatgaaccgtctggcatgcaggttgtgactgcaaaatagtgacctcgcgcaaaatgcactaataaaaacagggctggcaggctaattcgggcttgccagcctttttttgtctcgctaagttagatggcggatcgggcttgcccttattaaggggtgttgtaaggggatggctggcctgatataactgctgcgcgttcgtaccttgaaggattcaagtgcgatataaattataaagaggaagagaagagtgaataaatctcaattgatcgacaagattgctgcaggggctgatatctctaaagctgcggctggccgtgcgttagatgctattattgcttccgtaactgaatctctgaaagaaggggatgatgtagcactggtaggttttggtacttttgccgttaaagagcgtgctgcccgtactggccgcaacccgcagaccggtaaagagatcaccatcgctgctgctaaagtaccgagcttccgtgcaggtaaagcactgaaagacgcggtaaactaagcgttgtccccagtggggatgtgacgaagttcaagggcgcatctactgatgtgccttttttatttgtattcggtgactttctgcgtcttgtgggctgacaattgcccccgtttcttgtcacaataggcctttgcgcgcatcgatacgttgcgtgaggtacacagtcatctacagcggagtgttgttacaccatgatggacagcttacgcacggctgcaaacagtctcgtgctcaagattattttcggtatcattatcgtgtcgttcatattgaccggcgtgagtggttacctgattggcggaggcaataactacgccgcaaaagtgaatgaccagaaaatcagccgtgggcaattcgagaacgccttcaacagcgagcgtaatcgcatgcagcaacagctgggcgatcaatactccgagctggcagcgaacgaaggctatatgaaaaccctgcgtcaacaggtgctgaatcgtctgatcgacgaggcgctgctggatcagtacgcacgtgagctgaaactgggtatcagcgatgagcaggttaaacaggcgattttcgcgaccccagccttccaggttgacggcaaatttgataacagccgctataacggtatcctcaaccagatggggatgaccgccgatcagtacgcccaggcgctgcgtaaccagctcactacccaacagctgattaacggcgttgccggtaccgattttatgctgaaaggtgaaaccgacgagctggcggcactggtcgcgcaacaacgcgtggtgcgtgaggcgactatcgatgttaacgcgctggcggcgaagcagcctgtgaccgaacaggagattgccagctactacgaacaaaacaaaaacaatttcatgacgccggaacaattccgcgtgagttacatcaagctggatgccgcaacgatgcagcaaccggttagcgatgcggatatccagagctactacgaccagcatcaggatcaattcacccagccgcagcgtacccgctacagcatcatccagaccaaaactgaagatgaagcgaaagcggtacttgatgagctgaataaaggcggtgattttgctgcattagccaaagaaaaatctgccgatattatctctgctcgtaacggcggcgatatgggttggttagaagatgccactatcccggacgaactgaaaaatgctggtctgaaagaaaaaggccaactgtctggtgtcatcaaatcttcggtcggtttcctgattgtacgtctggacgacattcagccagcgaaagtgaaatcgttagacgaagtacgtgacgacattgcggcgaaagtgaaacacgaaaaagccctcgatgcgtactacgcgctgcagcagaaagtgagcgatgcggcaagcaacgacaccgagtctctggccggtgcagagcaagctgccggcgttaaagccactcagacgggttggttcagcaaagataacctgccggaagagttgaacttcaagccggttgccgacgctatctttaacggcggtctggtaggtgaaaacggcgcgccgggcatcaactctgacatcatcaccgtagacggcgaccgcgcattcgtgctgcgcatcagcgagcacaaaccggaagcggtgaaaccgttggcagatgttcaggaacaagttaaggcactggttcagcacaacaaagctgaacaacaggcgaaagtggatgctgagaaactgctggttgatttgaaagccggcaaaggtgcggaagctatgcaggctgccggtctgaaatttggcgagccgaaaaccttaagccgttccggtcgtgacccgattagccaggcggcgtttgcactgccactgccagcgaaagacaaaccgagctacggtatggcgaccgatatgcaaggtaatgtggttctgctggcgctggatgaagtgaaacaaggttcaatgccggaagatcagaaaaaagcgatggtgcagggtatcacccagaacaacgcacaaatcgtctttgaagctctgatgagtaacctgcgtaaagaggcgaaaatcaaaattggcgatgcgctggaacagcaataatcctgaagccgcctcgcaaaaaaatgcgttgcagctgtaacaagaaaaggtcgctttcgcggccttttccatttctgaacattgccatttgtttactgttttcactgccgttaaggtgattccactgttaacaaacaaggagaaaacagtatgaaacacggaattaaagcactgctcattaccctgtccctggcctgtgccggaatgtctcatagcgcgctggcggcagcttctgtggcgaaaccgacaacggtagaaaccaaagcggaagctcctgcagcacaaagtaaagcagcagtgccggcgaaagccagtgacgaagaaggcacccgggtcagcattaataatgccagcgcggaagagctagcccgcgcgatgaatggcgttggcctgaagaaagcgcaggcgattgtcagttatcgcgaagagtacggtccgtttaaaacggtggaggatctaaagcaggtgccggggatgggcaattcgctggtggaacgtaatctggcggtattaaccctgtaattaatttgcatagtggcaattttttgccagactgaagaggtcataccagttatgacctctgtacttataacaacaacgtaaggttattgcgctatgcaaacacaaatcaaagttcgtggatatcatctcgacgtttaccagcacgtcaacaacgcccgctaccttgaatttctcgaagaagcccgctgggatgggttggaaaatagcgacagttttcagtggatgacggcccataacatcgccttcgtcgtggtcaatatcaatattaactatcgtcgcccagcggtattaagtgacctgttaactattaccagtcagttgcagcaattaaacggtaaaagcggcatcttaagccaggtcattacactggagccggaagggcaggtggtagcggatgcgcttattacgtttgtttgtattgatcttaaaacgcagaaagcattagctctggaaggggaattgcgcgaaaagctggagcagatggttaagtaaacgttttgtggtgccggatgctcaagccgcatccggcgacacccggaataattacctcaacccggttttctgcttcatcgctgccatcaccgtcggtttatcggccagataatgattcaaaccgttggcgcgtaaattacatgccgcacaatgaccgcaaccgtcgcctttaatgccgttatagcaggtcaacgtttcgttacggactaaatccagtttgccgtaataatctgccagcgcccaggtttccgctttatcaatccacatcagcggcgtttcaaaacgaatatctttcgccatgcccaaactgacggcatggtttagtgctttcacaaactcatcgcggcaatccgggtagccggagaaatccgtttcacagacgccggtaattacggcttctgcttttacctgatacgcatatattgccgccagcgtcaggaacaaaatattacgccctgggacaaacgtattcgggatgccatcggcttcaggttcataatcaggcaccggaatgctgtcacgtgtcaggctgctgaccgccagctcgttgagcagcgttacatcaagaaccttatgcgcgcgtgctcccagtttcagcgccagttcgcgtgccacgtcgatttctgcgcgatgtcgctgaccgtaatcgaacgtcacgcaatggacttcatcatattgttgtaatgcctgcaccagacaggtggtggaatcctggcctccactgaacacaacgacagcacgtttcatagataatcctgcttgaacaataaaagcgttatggtaacgcctgcgattaacccggaccagctattcattgcgacggcgcgggaagccaggcttcggtaaattcaaaccagccgcgcggtgtcagtcgcacaccgttcacgccgggaggggcactaatgcgatagtgatagttgaacagcggcgtcagcgtcgcgtctgccattaactggctaaaaaccgctttcagggcattaaatcggttttcctcatcaggcattacttgcaccgcgtccagcgtcgattgcagatgtgcatatgctggagcgtcgaaaacatgtggccacagtggatcgcaacgtagccattgctccagagtatattccggtgcttcgccaattaatctgtcgcccatcatgaggtctgcgtgtgccagtagggtcgtgtcgtcccagttttttgcgttatgaaaaataattgtgagttcacagccttccgctgacagtgtcgcctgtaggcgttctgccatggtatgaagttctatcggtaggtgataaaccagcgtcaaggttttcggtagtttgacttcatccggtacttgccagtgcggaatagtccagcctggcagtaatgcatgactggcggtgatcaggttttctccgacttctaacgtttgtaataaaccggattgatgaataatggagatcacttttcgcgcctgccagagggagagtcggggacttttgcgcaacgttaaatagcaaaaacctaaactgatgccactactgacctggctgacccgttgcagctcctccggtttgccgatggtgatttgcacgggatgccgacaactggttcccaaatctttttcgaaaagcggcggagttatccagtactcaaccgctttaagcagcggatgacgcaaatggtaataatcatggctctccaggcgcaccagctccgctgtgaattgtgttaagcgaaaaggaccagtgccgatcagtgggaattgcggatgcaccagatggctgcaatagctcgccagccggtgcgcaagccagtaatcggggcgatgtaaaaagaaggtcagacactgcggatgggtgacttcaatacgcttcacgctaataaataattgatccagtgctggcagttgtaacagcatcaataatcgctggtgtaagtgtgaggcttttactgcatcgccgttatgccagtgtagggttgaacgaagataaaagtcccagcgtaacccgtcagtagaggtttcccagtgatgcgctaaatcgccaatcgggcgctgagtattattatcgaagcgggtcaggccggaaaatatctgcccggcgagatgctgctcggcacggccgggcaaaaagcctggttgtagcggttcgagcgggcgatagtagggaatacgcaacgtgggtgtatcgttttgccattgtccgcccataaacggctgtaacagagtgcgcagctcacctggggccagttgcgccagctccagcacatcttgctgctttccggtttccagtgcctgttccatcatcgcattgcgtagcgattccggcgtgaccagaaagcgtaattgtccgcgctttccgcgtcctgactgcgcctgccactccagccatcccgcctcctgtgcctgacgcaacagcgtacgaacatggcgttcgctgcaaaaacagcgttcggccagttcgctgacggtgacggtttgcggctttccggctgaaggttgccacagacgttgatactggttaagacggttgagcaatcgcatataaacccggaacaatattatttcactattcactattacttccgtatatatcaggtgatactcaatcaccattaaccgtgtcacagagtggagaaagaaatggctcgtctggcagcatttgatatggatggcactttattgatgcctgaccatcatttaggtgagaaaaccctctctactttggcgcgactgcgtgaacgcgacattaccctcacttttgccacggggcgtcatgcgctggagatgcagcatattctcggggcgctatcgctggatgcatatttgattaccggcaacggaacgcgcgtgcattctctggaaggtgaacttttacatcgtgatgatttacctgcggatgtcgcggagctggtgctgtatcagcaatgggatacccgagccagcatgcatatcttcaatgacgacggttggtttaccgggaaagagatccctgcgttgttgcaggcatttgtctatagcggttttcgttatcagataatcgatgtcaaaaaaatgccactcggcagcgtcaccaagatctgcttctgtggcgatcacgacgatcttacacgcttgcagatccagctatacgaagcattaggcgagcgtgcacatttgtgtttttccgccacggattgcctcgaagtgctgccggtgggctgcaataaaggcgctgcattgacggtgctgacccaacatttaggtttatcgttgcgcgattgcatggcctttggtgatgcgatgaacgatcgcgaaatgttaggcagcgtcggtagcggatttattatgggcaatgcgatgccgcaactgcgcgcggagctcccgcatttaccggtgattggacattgccgaaatcaggctgtctctcactatttgacgcactggctggactatccacatctaccttattcccccgaataacgagatcccttccagcaccgggcaattgcccggttttttttgcgttgaatttgtcattttgtgccgtggtgtttaaaccgcacagaataaattgtcgtgatttcacctttaaaatagaattaaaagagaaaaaaattctctgtggaagggctatgttagataaaattgaccgtaagctgctggccttactgcagcaggattgcaccctctctttgcaggcactggctgaagccgttaatctgactaccaccccttgctggaagcgcctgaaacggctggaggacgacggtatccttatcggcaaagtcgccctgctggatccggaaaaaataggcctcggcctgaccgcttttgtgctgataaaaacgcaacatcacagcagcgaatggtattgccgctttgtcacggtggttaccgaaatgccagaagtgctggggttctggcgcatggctggtgaatacgattatctgatgcgcgtccaggttgccgacatgaaacgctacgacgagttttataagcgtctggtaaacagcgtgccggggctgtcggacgtcacttccagcttcgcgatggaacagattaaatacaccacttctttacccatcgaataaatatccagaatcaggtcaggacacaacgcgtgcgattatttgctcaattaagctggtatttccgtcgggaatggcgtcgctatctcggggctgtcgccttgcttgtcattatcgcgatgctgcaactggttccaccaaaagtggttggtattgttgtcgatggcgtgacagaacaacactttactaccgggcagatcctgatgtggatcgccaccatggtgctgattgccgttgtggtttatctcctgcgttacgtctggcgcgtattgctgtttggtgcgtcttatcaactggctgttgaactgcgtgaagattattaccgtcagctaagccggcagcatcctgagttttacctgcgtcatcgcacgggtgacctcatggctcgtgcgactaatgacgtcgatcgcgtcgtgtttgccgccggagaaggggtgctgacgctggtggattcactggtaatgggctgcgctgtgttgattatgatgtctacgcaaattagctggcagttgaccttatttgccctgttaccgatgccagtgatggcgatcatgattaagcgcaacggcgatgctttgcatgaacgctttaagctggcacaggcggcgttttccagtcttaatgaccgcacccaggaaagcctcaccagtatccgcatgatcaaagcctttggtctggaagatcgccagtcggcgttatttgccgcggatgccgaagataccggcaaaaaaaacatgcgggtggcgcgtattgatgctcgtttcgacccgaccatctatatcgcgattggtatggcgaacttgctggcgattggcggcggtagttggatggtggtgcagggcagtttaacgctgggccagctcaccagttttatgatgtatttaggtctgatgatttggccaatgctggcgctggcatggatgtttaacattgtggaacgtggtagtgctgcgtacagccgtattcgcgcgatgctggcggaagcgccggtggtgaacgatggtagcgaacccgtgccggaagggcgtggcgaactggatgtaaatattcaccagttcacgtatccgcagactgaccatcctgcgctggaaaacgttaatttcgccctgaaacccggtcagatgctgggtatctgcgggccgactggttccggcaaaagtaccctgttgtcgctcattcagcgtcatttcgacgtcagcgagggggatattcgctttcatgatattcctctgacgaagttacaactcgatagctggcgtagccgcctggcggtagttagccagacgccattccttttttctgacactgtggcgaataacatcgcgctgggttgcccgaatgccacccagcaagagattgagcatgtcgcgcggttagccagcgtacatgacgatattttgcgtctaccgcaaggttacgatacagaggtgggcgagcgcggtgtgatgctttccggcgggcaaaaacagcgtatctccattgctcgtgcgttattagtcaacgcggaaatcctcatccttgatgatgcgctttcggcggtggacggacgcactgagcaccagatcctgcataacctgcgtcagtgggggcagggaagaacggtaatcatcagtgcccatcgcctttctgcactgacggaagccagtgaaattattgtgatgcagcacggacatatcgcccagcgtggcaatcatgatgtgctggcacaacaaagcggctggtatcgcgatatgtatcgctatcaacaactggaggcggcgctcgacgacgctccggaaaatcgcgaggaggccgtcgatgcgtagttttagccaactgtggccgactctcaagcgcctgttagcgtacggttcaccgtggcgtaaaccgctggggattgcggtcctgatgatgtgggttgcggcggcggcagaagtcagtgggccgctgcttatcagctattttatcgacaatatggtagcgaaaaataacctgccgttgaaagtggttgcagggctggctgcggcgtatgttgggctgcaactgtttgccgccgggctacattacgcgcagtcgctgctgtttaatcgggcggcagtaggcgtagtgcaacagttgcgtaccgacgtgatggatgctgcgttacgccagccattaagcgagtttgatacccaacccgtcgggcaggtgatttcccgcgtcactaatgacactgaagtgatccgcgatctctacgttaccgtagtggcaactgtcctgcgcagtgccgcgctggtgggcgcgatgctggtggcgatgttcagcctcgactggcgaatggcactggtggcgataatgattttcccggtggtgttggtggtaatggtgatataccagcgttacagcacgccgattgtccgtcgtgtgcgcgcctatctggcggatatcaacgacggctttaacgaaatcatcaatggcatgagcgttatccagcagtttcgtcagcaggcgcgatttggcgaacgtatgggggaggccagtcgttcacactatatggcgaggatgcaaaccctgcgcctcgacggttttctgctgcgtccgctgctgagtctgttttcatcgctcattctttgtggcttgttgatgctgtttggcttctccgccagcggcaccattgaagtgggcgtgctgtatgcgtttatcagctatcttgggcgacttaacgaaccattaatcgaactgaccacgcaacaggcgatgctgcaacaggctgttgttgctggtgagcgcgtgtttgaactgatggacggaccgcgccagcaatatggcaatgatgatcgcccgttacagagtggcaccatcgaagtcgataacgtgtcatttgcttatcgcgatgacaatctggtgctaaagaacattaatctctctgtgccttcgcgcaattttgtggcgctggtcgggcataccggcagtggcaaaagcaccctcgccagtttattgatgggctattacccgctaacggaaggtgagattcgccttgatggtcgtccattaagttcgctaagtcacagcgcgctgcgccagggcgtggcaatggtgcagcaagatccggtggtgctggcggataccttcctcgccaacgtgacgctggggcgggatatctccgaagaacgcgtctggcaggcgctggaaaccgtgcaactggcggagctggcgcgtagcatgagcgacggtatttacacgccgctgggcgagcaggggaataatctctcagttgggcaaaagcaactgctggcactggcgcgcgtgctggtcgagacgccgcaaatcctgatccttgatgaggcaaccgccagcattgactccggtactgaacaggcgattcaacatgctctggcggcggtgcgtgaacataccacgctggtagtgattgctcaccgcttatcgaccattgttgatgccgacaccattctggtgcttcatcgtgggcaagccgtggagcagggcactcaccagcaactgctggcggcccagggacgctactggcagatgtatcaactgcaacttgcgggcgaagagctggcagccagcgtgcgtgaagaggaatcattgagcgcctgaatagcgcaatatttcatcgttggtgcaaaaatgtaacgcactgtgcactgtcatagtgcgttttcattttcaaacttcttaacttcctgctctctttctcgtttttcatttctggcacaccgcttgcaataccttcttcgtgtagcagaaccattaccgaattctgaccggaggggatctatgaagctggtgaccgtgataatcaaaccattcaagctggaagacgttcgtgaagcgttatcttccattggtattcagggcctgaccgtcaccgaagtgaaaggtttcgggcgtcagaaagggcatgccgagctgtaccggggggcggaatacagcgtcaatttcctgccaaaagtaaaaattgatgtggcgattgctgatgaccaactcgatgaagtgatcgatatcgtcagtaaggcggcttacaccggaaaaattggcgacggcaaaatcttcgtcgctgaattgcaacgcgtcattcgtattcgtaccggcgaagccgacgaagcggcgctgtaatctctggcacacagcaacaggaacgaaaaatgaagatagcgacgataaaaactgggcttgcttcactggcgatgcttccgggactggtaatggctgcacctgcggtggccgataaagccgacaatgcgtttatgatgatttgtactgcgctggtgctgtttatgactattccggggattgccctgttttacggtgggttgattcgcggcaaaaacgtgctgtcgatgctgacgcaggtgacggtgacatttgcactggtctgtattctctgggtggtttacggttactcgctggcgtttggtgagggcaacaacttcttcggcaacattaactggttgatgctgaaaaacatcgaactgacggcggtgatgggcagcatttatcagtatatccacgtggcgtttcagggatcgtttgcctgcattaccgtcggcttgatagttggggcgctggcggaacgaatccgcttctcagcagtgttgattttcgtggtggtatggctgacgctctcttacattccgattgcgcatatggtgtggggcggtggtttgctggcttctcacggtgcgctggatttcgcgggtggcaccgtggtgcacattaacgccgcaatcgccggtctggtgggcgcgtatctgataggaaaacgcgtgggcttcggtaaagaggcgtttaaaccgcacaacctgccgatggtcttcaccgggactgccattctctatatcggttggtttggctttaacgccgggtcagcgggcacggcgaatgaaatcgcggcactggcatttgtgaatactgtggtcgcaacggcggcggcaattcttggctggatcttcggtgaatgggcgctgcgtggtaagccttcactgctgggggcgtgttctggcgcgattgccggtctggtcggcgtgacgccagcctgcggctacattggggttggcggcgcgttgattatcggcgtggtagctggtctggcgggcttgtggggcgttaccatgctcaaacgcttgctgcgggtggatgatccctgcgatgtcttcggtgtgcacggcgtttgtggcattgtcggctgtatcatgaccgggatttttgccgccagctcgctgggcggcgtgggcttcgctgaaggtgtgacgatgggccatcagttgctggtacagctggaaagcatcgccattacgatcgtctggtccggtgttgtggcatttatcggctacaaattggcggatctgacggttggtctgcgtgtaccggaagagcaggagcgagaagggctggatgtcaacagccacggcgagaatgcctataacgcgtaacaagcactgcaaaaaacagccggacggttttcacctccggctatttttttaattgtgattacgcatcaccccttcctgaacggtcgaggcaaccagtacgccgtcttgggtataaaactcaccgcgcacaaagccacgtgcgctggacgccgaggtgctctccacgctatacagcagccattcattcaaattaaacgggcgatggaaccacatggaatggtcaatggtggcaatctgaatccccggttcgagaaaaccgatgccgtgcggctgtagagctaccggcaggaagttaagatcagaagcgtaaccgagcagatactgatgaacgcgcaggtcatccggcacgctaccatttgcgcggatccacacctgacgatgtggttctgcgacgtgacctttcagtgggttatgaaactccaccggacggacttccagcggacgatcgcagatgaatttatctttcagcactggcggcagcaggtgcgccagcgattgggcgatttgcgtttccgaaggtaggccatcaggcgctggcgcggacggcattgttttttgatgttcgaaacccgcttctggtgcctggaaagaggcagtcatataaaaaatcggtttgccgttttgaatagcagcaacccggcgggcgctgaagctgttaccgtcacgcagcgtttcgacatcataaataatcggcttcttactatcgccagggcgaagaaagtagctgtgaaacgaatgtaccagccgctcttcagggacggtctcttttgcagcatacaaggcctgacccacgacctggccgccaaacacctggcgtaaacctaaatcttcactctggccgcgaaagagtccttcctcaattttttccagatttaacaatgtcagtaaattttttagcgcctgactcatataactctccagtaacaaagctgccgcagcaagccaaagtgagttgagtataacgcaaatttgctactggtccgatgggtgcaatggtctgaattacgggctaattacaggcagaaatgcgtgatgtgtgccacacttgttgacgttactattttgttaaccactcttccggcgaggaaagttagcccgctggtgcattgataataaggagaaatgaatgaaactcgtgcacatggccagtggtttagcggttgcgattgcgttggcggcttgcgcagataaaagcgcggatattcagacgccagcaccggctgcaaatacgtctatttcagcaacacaacaaccagctatccagcaaccgaatgtctccggtaccgtctggatccgtcagaaagtcgcactgccgcctgatgctgtgctgaccgtgacactttctgacgcgtcgttagccgatgcaccgtcaaaagtgctggcgcagaaagcggtgcgtactgaaggtaaacagtcaccattcagctttgttctgccatttaacccggcagatgttcagccgaacgcgcgtattctgttgagtgcggcgattaccgtgaatgacaaactggtatttatcaccgataccgttcagccggtgatcaaccagggcggaactaaagccgacctgacattggtgccggtacagcaaaccgccgtgccggttcaggccagcggtggcgcaacgactaccgtaccttcgacttcaccaactcaggtgaatccgtcttcggcagttccagctcctacgcaatattaagcgacgttaaccctctccgcccggagagggttagtagttccagcgataacgctgcaagtcgatttgcccgcttcccgataccatcacaccttctgccagtaatgcctgtcgctgacgctgtaaatccggtccggttagcgaaattgtgccgtggcgattaaccacccggtgccagggtaaggtgctgccttcagggagacgctttaacacaccgcccacctggcgcgcggcgcggggcgatcccgccagtttcgccacatcaccgtaagtggtgacatagccttcgggaatagcggcgacgatttgccagacgcgttggggaaatgaatcttctttttccatcttttcttcctgaggtaatttttcagcataatctggaaaaacgcccgagtgaagtcgcattgcgcaagaaaccagcatctggcacacgatgggttgcaattagccggggcagcagtgataatgcgcctgcgcgttggttctcaacgctctcaatgggggctctgttggttctcccgcaacgctactctgtttaccaggtcaggtccggaaggaagcagccaaggcagatgacgcgtgtgccgggatgtagctggcagggcccccacccatttctgcctcccaccgtttcgtcaaaaaatcccaacatggctaaactttaaccacaactgacgtcgcaagaattgtctggctgcgcagtacgcttcggaggtatgtctgatgaagtaggttgatggttttgtggttgccgttcctgccgataaaaaggatgcctatcgggaaatggccgctaaggctgcgccattgtttaaagagtttggcgcgcttcgtattgtcgaatgctgggccagcgatgtaccggatggcaaagtgaccgattttcgtatggcggtgaaagcggaagagaatgaagaggttgtctttagctggattgaatacccttcaaaagaggtccgcgacgctgctaatcaaaagatgatgtcggacccacggatgaaagagttcggcgagtccatgccgtttgacggcaagcgaatgatctatggcggattcgagtcaatcatcgacgaataggtagcgtgacgggctgtgcggcgtgccgtcagcccaaaaattcacaaatgttgctcggcccagcgtaagaaatcttctttcggtaatgccttgctgtagagccagccctgaccgtagtgcacgccatgctggcgtaaccactcttcttgtttactggtttcgattccctccgctaccattttcagtttcagtgtttttgccatttcgatgatatgcggcgtgacatttttatattccagcgcatcaacgaaagatttatcgatcttcagaatgtcgacatccagatcctgtaaataacttaaacttgaataccccgtaccaaaatcatcaagataaatttcatggcccgcctcccggtagcgagaaattatcggggcgctggttttcggatcggcaaactcgcgttcagtgagttcaagcgcgatctgtctgggattaacctgatagtgattgatcatgtcacgcagcaattgcgggattttttccgaggtgagcacgggggattcaagattgatcgaaatatgctgctgtggatgctgacgcagccagtcgcccatatcttcaaagacgcttcttataatcagtagcgtcaatggctcagaaaggcccgtttgctgtgccagcggaataaaactatctggtgacaaccaactaccgtctgtctgcggccagcgcgccagtgcctcagcaccgacaattttgccattggctaaggagacaatcggctgatagtgcacgcaaatatcacgattatcgatagcatcctgcagccgatgatgcggtgactgaatacggcgcaaaatacgcagcacaaacatcgctgccagcaggccaatcaccaacccgagcggtaaccaaataaagacttgccgatgccagcctttctgcaacattttcgttgaagcccatgtgatgatcgaaatattcatctccggtaagggcaggatatcgtaaatgattccattattttcgatatgctcaccgggtgttttttgtagcctggtaataattccctgagcaatttcatcgctgctggttatgacaacgttatgggcattgccaataatggcggcatcaatttgccatgagctatagggaatgacatcaataaaggaagcggggtcgatcatgacgacataatgtgccgttcccatggcgaccatgtaacggataatgcctaaatcgttatgcgatgttaaccagacacgataaccatctttcgaaattttacctggctcggggaaggtatcgggcggactttcatgctccagagacgaacactggggaacgttgttatcgatataagccacttcctgaatatagcgataactgtaagatacccgacgcatttccatgagatgggcttcgctacaggcagcgccttgccatctttccagctcctgcagcgcatctttcccttgtgtcgccaccttattggctcgaatagcgacgcgggaggaataggtatccagctcttcaataaacgatgtttctacctgctgatgggccagccagatgcttaagccgacaggcagcaatactgaaagaatcagtactcccgaaataaggccgaccagatgtcgtgttctcaccagcatatccttattaacacagtgtagggaaagtatatctgattgtggaaaaaggctggctggagataaggaggtagagctggtatttcatgaagtgatgggtggaaacgatcattgtcatttgaccaggcgcagagctttacgcctggtatgtaaccctaacttaagatgttgattcggcgcgagcgagggtaaaaatatcgtaaaaagacagttcacctttacggacgatcattttttgcagttgttccttatgaacatccgcgacacgcggagagttcaagatggcttcaaccagcgcggcaggtacaaagcgcgtgttgtaccattcgccgttatagcaaacgcggaaatccagcacgtcgatatcttcatagcggtagcgtgggtagacatcgaaaaagaagaaaccattaagcaggataaataatacaaccagtagccagacagagcctgacagcgtttcggactgcaacatcaccgccagggtggcaaaaaaagcaacgtacataccgataaacagccccggatgtttacggataaaactgatactaaagcggggtttgttgtcgcgtttttcgcgggtattcagagactcaatcgtttcggtcagcaggcgttgtatttcggtcatcgtttgccttcgtggtatctgcaactttccagggaacaccctattttaacgtgggaatagtagaggggaagtaacagatctaccacaattttgcataacagttgcgaaaaaccgattacaattttttaattattctggctggattaccgcccacgacaacgttgtccgggacatcttttgtgacaactgcacctgaggctaccacgacgttatcaccaatggtcacaccagggttaatgaccgcgcgtccgccaatccagacgttattaccgatggtgacgggtttccccagttcagcaccgctattacgtgctacagggtcgatgggatgtgttgccgtgtagatatgaacgcctggtgccaacatacagttatcaccgatgcgaatagggcagacatcaagcatcacgcaatcgaagttggcgaaaaaattattaccgagaaaaatgttatagccatagtcacagcgaaacgttggctcaatataagcctctgtcacctgaccgaatagatcagcgagaatttgctggcgtaatgtgtgctcttccgccagggaatgattgtatcggtgaataagctgacgagcgcgcaggcgatcgcgagataacgtctcatctgccgagcgatacaactcaccagcaatcatcttttctttttctgtgctcattactgacctccggttgctgaaaatgcggcaacacagtaagacgaaaagtcagtgaagagaacgttcccattacatctgtgtgataaagatcacatagggtatgttttcatggcgaaaaagtataaaattcttaataaacagccggttatagctccgaaagcgaattatttattagcgaataaatttccaaactgaggaagggatcttgtcgtacagtttattcatggtcaattcggcgaggcggtgatctgcggctgagtaaaataccgccagttcattatctgataattcgtatttatttttctcgataacacgctccagcgtgtcaattgtctggcaacgacgtaaacgcattaaataatcggttttcgttaaaggtttttcggacatacttctacccatggttgtaataattctaacaagataaactcgcaggattctctttcgtcgcattgacaaaacaacggaatagtcgattacctgacttccgccatttctgaagatcctgcatattaataccataactactgaacaacataaaggtgtcatccagatattcgtcgatctgctcaatgagcttattgtcttcattatacttaattttgtaattaagtgcgaaggtcgcaatatgctcaatcagttcattcaactggaggttgatcgccgaggttgggtcgttaacccagccatgattgctttcttcaaggtttgcaaggcagtcatgatacagggtttcacagagaaacttaagctgtgcgatatcatgtcttttgggtgagtattcatccataacgcgtccccttcttagcggttgaactaacggacacctttcgggatggaaaaaacttactgacctggacttgccctctcgtttgttagcttaactataagccactctttgcaggttttcatcgcattattacgaaaaattacaattaggaaggaagcgggacaggactcactttttcatactagcaccaacccgcagcaggtaaaagcagtttgctcgaacagtttataacatttcaggattatcgccagatgacattggtgacactaataccaggattgctctgaatatgacgtaataaccgaggaatgaataaagaattaccgcaaataattaagaatagcctctaaatgattatggattattaaatctattagcgctacttaatataaattaactaacaatcagtattttttatgaattttatccgtggttaatactggttttcgtatgagatcctgagttggtggttcaattactccttaatgttcgtaggttatgcataaaaaaggccgcttgcgcggccttagtgattacacgttgtatcaatgatgatcgacagtatggctgtgctcgatatcttcattcttgcggctaaagcggcggcgaaccaccacaaagaataccggaacgaagaagattgccagtaccgttgcggtcaccatcccgcccattacaccggtacctactgcgttctgcgcgccggaaccagcaccagtactgataaccagcggcataacgccgaggataaacgcaagcgaggtcatcaggatcggacgtaaacgcatccgcaccgcatcaagcgtcgcttcaatcagacctttaccttctttatccatcaagtctttggcgaattcgacgataagtatcgcgttcttcgccgacaacccaatggttgtgagcaggcctacctggaagtaaacgtcattggtcaggccacggaaggtggcagccagcaacgcaccgataacccccagcggaacgaccagcataacggagaacggaatcgaccagctctcgtacagcgccgccagacacaggaacacgacaatcaacgaaatcgcgtacagtgaaggtgcctggttgccggagagacgttcctgataggacatccccgtccagtcatagccaacaccggtaggcagtttgctcgccagttgttccatcagctccattgcttcaccggtacttttacccggtgccgcctggcctaagatttccatggatggcaggccgttgtaacgttccagacgcggcgaaccgtactcccaacgagaagaggagaacgccgagaacggcaccatctgaccatcagcagcacgaacataccagtcgccgatatcatccggcagcatacggtatttcgcttctgacatgacgtaaactttcttcacacgaccgcggtcgataaagtcgttcacatagctaccgccccatgcagcgcccagagtggtgttaatgtcgttgatagaaacacccagcgcctgcgctttttcctggtcgatatcaatcttaaactgcggggtatcttccagaccgtttggacgtacgctggtcagcatatcagggtgcttcgctgcttctgcaagcagctggttacgcgcctgagtcagtttttcgtgaccaaggccagcctggtcaatcagctcaaagtcaaagccggttgcagtacccagttccacgattgcgggcaggttaaaggcgaaaaccatcgcatctttgatttgcgagaaagcgcgtgttgcacgcatggtaatcgcttcaactttgttttcttcgcccggacgatcggcccagtccttcaaggaaacgaacgcaataccggtattctgaccacgtcccgcaaagccgaagccgttaacggcgaacaccgactcaacgttgttcttttctttggtcagatagtaatgcgttacctcattgagcactttctgcgtacgttcctgcgttgcacctgctggcagctgaaccatggtcataaatacgccctggtcctcatctggcaagaaggagcttggcagacgcacgaacagataggccatgccgaccacgatgatcagatacagcaccaggtaacgccctgtactgcgcagaataccgcctacgctgtcggtgtagtggtgcgtgctcttctcgaacatgcggttaaaccagccgaagaagccttttttaccttccccgtgatcgcctttggcaatcggtttcagcatggtggcacaaagagccggagtcaggatcaacgctaccagtaccgacagcgccattgctgaaacaatggtaatagagaactgacgatagatagcaccagtagaaccgccaaagaaggccatcggtacgaataccgccgacagtaccatcgcgataccgaccagagcgccctgaatctgccccatcgacttacgggtagcttcttttggcggcaaaccttcttccgccataacacgctcaacgttttctaccacaacgatggcgtcatccaccaacaggccgatggcgagcaccatcccgaacattgttagcgtgtttatcgagaagccaaaggcggcaaggacggcaaaggtcccgagcaataccaccggtacggcaatggtcggaatcaacgtcgcgcggaagttctgcaggaacagatacataaccaggaacacgaggatgatcgcttcgaccagcgttttaaccacttcgtgaatagagattttcacgaacggcgtggtgtcgtacgggtaaacaattttcagacccgacgggaagaacggttccatcttcgccagttcagcacggattgccgcagcggtatccagcgcgtttgcaccggtcgccagcttgatccccagaccggaagccggttggccgttaaactctgcgatgatgtcgtagttctcaccacccagctcaatcttcgccacatcacgcagcagtacgcgggaaccatcctgattcactttcagcaggattttgccgaactcttcagtagaggtcagacgcgtctgagcaataatagaggcgttaagctgttggcctttcaccggcggcgtaccaccgagctgacccgccgcaacctgggcgttctgcgctttgatggcggtaatgacatcaaccggcgttagctggaatttgttcagctcattcgggttcatccagatacgcatcgcgtactgtgaaccgaacaactgaacatcacccacgcccgacgtacggctgatggcatctttcatattcgccgctacgtagtcagagatatcctcctgcgtcatggtgccatcggtgttgataacgccgacaaccatcaggaagctgctggatgatttctcaacgctcaccccttgctgctgaacttcttgcggcagcaacggcatcgccagctgcagtttgttctgcacctgaacctgcgcgatatccgcatcagtaccagactcaaaggtcagggtgatctgcacggtacccgtggagtcactgttagaggacatgtacatcaggttatcgataccgttcatattctgttcgataacctgtgtcaccgtgtcctgcactgttttcgcatcagcgccggggtaggaggcggagatcgttactgccggcggtgcaatcgtaggatattgcgccaccggcagtttgaggatcgccagcccccctgccaacatgatgataatggcgatcacccacgcaaaaatcgggcgatcgataaagaaattaggcatgtcttaacggctcctgtttaagttaagacttggactgttcaggctgagcaccgcttgcggcttgctggttattatcagcggtaacttcttgtgcttttacctggacaccaggacgcactttctgcagcccacttattactacgcgatcgcctgctttcagaccttctgtcaccagccacttatcgccaatagcctggcttgcaacgatcggacgggtttccactttgtcatccgcgccaactaccagtacggtggcatcgccacgcggcgtacgggttacgccctgttgcgggactaaaatagcgtttggattaagcccttcttccagacgtgcgcgcacgaacatacccggcagcagagtgtgatccgggttcgggaagatagcgcgtagggtgatagacccagtggtctgatcaacggtaacgtcagagaattccagcgtaccgtcctgcgggaacttaatgccgtcactggtgatcagtgacactttggctttgccgttctcttgtttcagcgtgccattcgccagttcctgtttcaggcgcaggaagtcgttgctggactgggtcacatcaacgtagatcggatcaagttgctgcacggttgccagcgcagtcgcctgaccgttctgtaccaatgcgccttccgtcacgttcgacttaccaatgcgaccgctaatcggagaggtgactttggtgtaagccagattgatccgcgcagtttcaacggcagctttcgccgcagttaccgcagcattcgcctgttgcgcatcagccagagcctgatcgtactcttgcttactgatgtactgagtaccgagcagtttctgataacgattcaccgtcaattgcgcgatattggctgcagcctgggctttcgccagatcacctttcgcactgtcgtatgtcgcctgataggtcgcaggatcaatctgatagagagagacacctgcttcgatgtcgctaccttctttgaaattacgcttcaggataatcccgctaacttgaggacgaacttctgcgatccggtaggcactggtgcgacccggaagctcggttgtgatctgcagaggttcagttttgactgttactacgccaacggcgggcatctgctggccaccttgttgggcctgtttgtcgtcacatcctgttagggctaagctgcctgagagcatcagaacgaccgccagaggcgtaaaccctctgtttttgttcatatgtaaacctcgagtgtccgatttcaaattggtcaatggtcaaaagttaataaacccattgctgcgtttatattatcgtcgtgctatggtacatacattcacaaatgtatgtaaatctaacgcctgtaaattcacgaacatatggcacgaaaaaccaaacaagaagcgcaagaaacgcgccaacacatcctcgatgtggctctacgtcttttctcacagcagggggtatcatccacctcgctgggcgagattgcaaaagcagctggcgttacgcgcggtgcaatctactggcattttaaagacaagtcggatttgttcagtgagatctgggaactgtcagaatccaatattggtgaactagagcttgagtatcaggcaaaattccctggcgatccactctcagtattaagagagatattaattcatgttcttgaatccacggtgacagaagaacggcgtcgattattgatggagattatattccacaaatgcgaatttgtcggagaaatggctgttgtgcaacaggcacaacgtaatctctgtctggaaagttatgaccgtatagaacaaacgttaaaacattgtattgaagcgaaaatgttgcctgcggatttaatgacgcgtcgcgcagcaattattatgcgcggctatatttccggcctgatggaaaactggctctttgccccgcaatcttttgatcttaaaaaagaagcccgcgattacgttgccatcttactggagatgtatctcctgtgccccacgcttcgtaatcctgccactaacgaataaccctgaatctgactccaggatttttcctggacattttcgtcgttgctattctggttcactgcgtcgtgatattcttgcggtttgactttttcaggtcgttcttcaggttcagaaaccttcattcatcatgactatgttccagtattacaaacgatcacggcattttgttttttcagcatttattgcttttgtttttgtcttgttatgccagaacacggcgtttgcgcgggcgtcatcgaatggtgatctgccgacaaaagcggacctgcaggcgcaacttgactcactaaataaacaaaaagatctttctgctcaggacaaactggtgcagcaggatctgacagatacattagccaccctcgataaaatcgatcgcataaaagaagagacagttcagctacggcaaaaagtcgctgaagcgccggaaaaaatgcgccaggcgaccgcggcgttaacagcacttagcgatgtcgataacgacgaagaaacgcgcaaaattctgagcacgctttcgttgcgccagctggaaactcgcgttgcccaggcgctggacgatttgcaaaacgcacaaaacgatctggcgtcttataacagccagctggtttcgttacagacgcagcccgaacgcgtgcaaaatgcgatgtataacgcttcgcagcagctgcaacaaattcgcagtcgtctggatgggactgatgtcggcgagacagccttacgtcccagccagaaagtgttaatgcaggcccagcaggcgttgctgaatgcggagattgaccagcagcgtaaaagcctggaagggaacaccgtcttgcaggataccttgcaaaagcaacgtgattacgtgacggcgaacagcgctcgtctggagcaccagttacaactgttgcaagaagcggtaaacagcaagcgcctgactttaaccgaaaaaacggcgcaggaagccgtctccccggatgaagccgcgcgtattcaggctaatccgctggtgaagcaggaactggaaattaaccagcagttaagtcagcgtctgattaccgcgactgaaaacggtaatcagttgatgcagcaaaacattaaagtcaaaaactggctggagcgggcgctgcaatcggaacgcaatattaaagagcagattgccgtcctgaagggcagcctgctgttgtctcgtatcctttaccagcaacaacaaacgctgccctcggcggatgaactggaaaacatgaccaaccgcatcgcggatttgcgtctcgaacagtttgaagttaaccagcagcgtgatgcactcttccagagcgatgcgttcgtcaacaaactggaagaaggtcacaccaacgaagtcaatagcgaagttcacgatgcgttattgcaagtggttgatatgcgtcgcgaattgctggatcaactcaacaaacagttgggtaaccagctgatgatggccattaacctgcaaatcaaccagcagcagttaatgagtgtgtcgaaaaacctgaaatccatcctgactcagcaaatcttttgggtgaacagtaaccgtccaatggactgggactggatcaaagcgttcccgcaaagcctgaaagatgaatttaagtcgatgaaaatcacggtgaactggcaaaaagcctggcccgccgtttttatcgctttcctcgctggtttgccgctgctgttgattgccgggctgatccactggcgtctgggctggctgaaagcgtatcaacaaaaactggcttccgctgtgggttccctgcgtaacgacagccagctcaacacaccaaaagcgatccttatcgacctgatccgtgcgctgccggtgtgcctgattattctcgcggttggcctgattctgttgaccatgcagctcaacatcagcgaactgctatggtcgttcagcaaaaaactggcgatattctggctggtgtttggcctgtgctggaaggtactggagaaaaacggcgttgccgtacgtcacttcggcatgccggaacagcagaccagccactggcgtcggcaaattgtccgcatcagtctcgcattgctgcctatccatttctggtctgtggtggcagaactttccccgctgcatctgatggatgatgtgctggggcaagcgatgattttcttcaacctgctgctgattgccttcctggtatggccgatgtgccgcgaaagctggcgtgataaagagtcgcacaccatgcgactggtcaccattaccgtgctgtcgataatcccgattgcgctgatggtgctgactgctacaggctacttctacactacgctgcgtctggcaggacgctggattgaaaccgtttatctggtgatcatctggaacctgctgtaccagacggtactgcgtggcttaagcgtagcggcgcggcgtatcgcctggcgtcgtgcgctggcgcgtcggcagaatctggtgaaagagggcgcagaaggtgctgaaccgccggaagaacccaccattgcactggagcaagttaaccagcagacgctgcgtattaccatgttgctgatgtttgcgctgttcggtgtcatgttctgggcaatttggtccgatttgatcaccgtgttcagctatctcgacagcatcacgctctggcattacaacggcactgaagctggcgctgcggtggtgaaaaacgtcaccatgggcagtctgttgtttgcgattatcgcctcaatggtggcctgggcgttgattcgcaacctgcctggtttactggaagtgctggtgctctcgcgactgaatatgcgccagggcgcgtcgtatgccattactaccatccttaactacatcattattgctgttggtgcgatgacggtgttcggatcgctgggcgtctcttgggataaactccagtggctggccgcagcattatccgtaggtcttggttttggtttacaagaaattttcggtaacttcgtctccggtttgatcattctattcgaacgtccggtgcgtattggcgatacggtaaccattggtagcttctcggggacggtaagtaagatccgtattcgtgcgacaacgattaccgatttcgatcgcaaagaagtgatcatcccgaacaaagcgtttgttaccgagcgtctgatcaactggtcgttgactgacactactacgcgtctggtgatccgtctcggcgtggcctatggctccgatctggaaaaagtgcgtaaagtgttactgaaggcggcgactgagcacccaagagtgatgcacgaaccaatgccggaagtcttctttacggcgtttggtgccagcacgttggatcatgagctgcgtctgtatgtgcgtgaactgcgtgaccgtagtcgtactgtcgatgagctgaaccgtactatcgatcagctgtgccgtgaaaacgacatcaacattgcctttaaccagcttgaagtgcatctgcacaacgagaagggcgatgaggtgacggaagtaaaacgcgactacaaaggcgacgatccgacaccagcggttgggtaataaccaaagggggcgacatttagttgccccgagattactgacaaagtgcgcgttgttcatgccggatgcggcgtgaccgccttatccggcctacgaaaccgcaagaattcaatatattgcaggagcggtgtaggcctgataagcgtagcgcatcaggcagttttgcgtttgcccacaatcttaggggacatttagcggccccatttatttctcacttttccgcctcatcatcgcgcgttaatttcttttcataatcgcgttttacaatatccagcgcgcgcagcacggtgcgggctgggatctgattttcttccagcagcacaatcaaatcgacagccagtttgacatcgtcaggggcattttcaagtgacatactctctccattgctagcgggttaagcgcgctagcctgttttcgattttttccagcgcatggcggcagcgtgccaggcgcgcttcataggcttccacttcacgatgcagcgtttgctgttccacgagatcggtcacccgcaccaggcgggctctgcgttcggcaaccatctcacgtagccgccgctcaaaatcctgatgctgaatacgtttacgctgccagcgggcaattttcggtggcgcactgtcccactcgcgcaatgaccaggcggaggcttcacgcgcgatggcttccagttgtgccgccagatgttccgccagccaggccacttgcggcagctgttgctgctcaactgcatgacgaagcgcagccagattatcgcccgcctcgtcgagacaagcctgtagtgttgtcgcacgagtctgaaaaagatgcctgtcgaaacgagcacttagcgtggcgaactgtgacaccggggcacaacgctgacgcagcgtagcgagctgtccttccagtttttccagcagcagggcggttttcacgataagacctcaatgaaaatgataattgttatgctaaagtagccactctgtaagctgacaacactcaatatgcaacgaatcattttaatcatcattggctggctggcggtagtgctgggtacgctgggcgtggtattaccggtattaccgacgacgccgtttatcctgctggcggcctggtgctttgcccgttcttccccgcgctttcacgcctggttgctgtaccgctcatggtttggcagctatctacgtttctggcagaaacatcatgcgatgccgcgcggcgtcaaaccgcgggcgattttgcttattttgctcacgtttgccatttctctgtggttcgtccagatgccatgggtgcgcatcatgttgctggtaattctcgcctgtttgcttttctatatgtggcgaattccggtgattgatgaaaagcaagaaaagcactgaagcacaacaatcgcagttgcaattattgcgtacagccagtacattctggcgttttcgagcacaggcgcaggcggtcaaaggttaaacaactgttacttttgatacgtttaaaacgcgccgtgagtaccaccgtaacaagcaggcatacacttatgaccgcgactgcacagcagcttgagtatctcaaaaatagcatcaaaagcattcaggactacccaaaacccggcattcttttccgcgatgtcaccagcttactggaagacccgaaagcttacgctctcagcatcgacttgctggttgagcgttacaaaaatgcgggcattaccaaagttgtcggcaccgaagcgcgtggcttcttgtttggcgctccggtagctctgggtctgggcgttggctttgtgccggtccgtaaaccgggcaaactgccgcgtgaaactatcagtgaaacttacgatctggaatacggcaccgatcagctggagatccacgttgatgccatcaaaccgggcgacaaagttctggtggtggacgatctgctggcaaccggcggcactatcgaagcgaccgttaaactgatccgtcgtctgggtggtgaagtggctgacgctgcgttcattatcaacctgttcgatctcggcggcgaacagcgtctcgaaaaacagggcattaccagctacagccttgtcccgttcccgggccattaattatcgccagtcttgtgctgcccacgctacggacagcacaagatgtgcattcagcctcgccgttctgacggggctgtgttagcattaccccttcgtgaatccaccttccagcgtttcagagcctgccaatgagttatcaggtcttagcccgaaaatggcgcccacaaacctttgctgacgtcgtcggccaggaacatgtgctgaccgcactggcgaacggcttgtcgttagggcgtattcatcatgcttatcttttttccggcacccgtggcgtcggaaaaacctctatcgcccgactgctggcgaaggggctaaactgcgaaaccggcattaccgcgacgccgtgcggcgtgtgcgataactgtcgtgaaatcgagcaggggcgctttgtcgatctgattgaaatcgacgccgcctcgcgcaccaaagttgaagatacccgcgacctgctggataacgtccagtacgctccggcgcgtggtcgtttcaaagtttatctgatcgacgaagtgcatatgctgtcgcgccacagctttaacgcactgttaaaaacccttgaagagccgccggagcacgttaagtttctgctggcgacgaccgatccacagaaattgccggtgacgattttgtcacgctgtctgcaatttcatctcaaggcgctggatgtcgagcaaattcgccatcagcttgagcacatcctcaacgaagaacatatcgctcacgagccgcgggcgttgcaattgctggcgcgcgccgctgaaggcagcctgcgagatgccttaagtctgaccgaccaggcgattgccagcggtgacggccaggtttcaacccaggcggtcagtgcgatgctgggtacgcttgacgacgatcaggcgctgtcgctggttgaagcgatggtcgaggccaacggcgagcgcgtaatggcgctgattaatgaagccgctgcccgtggtatcgagtgggaagcgttgctggtggaaatgctcggtctgttgcatcgtattgcgatggtacaactttcgcctgctgcacttggcaacgacatggccgccatcgagctgcggatgcgtgaactggcgcgcaccataccgccgacggatattcagctttactatcagacgctgttgattggtcgcaaagaattaccgtatgcgccggaccgccgcatgggcgttgagatgacgctgctgcgcgcgctggcattccatccgcgtatgccgctgcctgagccagaagtgccacgccagtcctttgcacctgtcgcaccaacggcagtaatgacgccaacccaggtgccgccgcaaccgcaatcagcgccgcagcaggctccgactgtaccgctcccggaaaccaccagccaggtgctggcggcgcgccagcagttgcagcgcgtgcagggagcaaccaaagcaaaaaagagtgaaccggcagccgctacccgcgcgcggccggtgaataacgctgcgctggaaagactggcttcggtcaccgatcgcgttcaggcgcgtccggtgccatcggcgctggaaaaagcgccagctaaaaaagaagcgtatcgctggaaggcgaccactccggtgatgcagcaaaaagaagtggtcgccacgccgaaggcgctgaaaaaagcgctggaacatgaaaaaacgccggaactggcggcgaagctggcggcagaagccattgagcgcgacgcgtgggcggcacaggttagccaactttcgctaccaaaactggtcgaacaggtggccttaaatgcctggaaagaggagagcgacaacgcagtatgtctgcatttgcgcacctctcagcggcatttgaacaaccgcggtgcacagcaaaaactggctgaagcgttgagcacgttaaaaggttcaacggttgaactgactatcgttgaagatgataatcccgcggtgcgtacgccgctggaatggcgtcaggcgatatacgaagaaaaacttgcgcaggcgcgcgagtccattattgcggataataatattcagaccctgcgtcgattcttcgatgcggagctggatgaagacagtatccgccccatttgatcgtaagcacagcttacgttcgtcatccttaacgtgattgagagagaaacctatgtttggtaaaggcggtctgggtaacctgatgaagcaagcccagcagatgcaagaaaaaatgcagaaaatgcaggaagagatcgcgcagctggaagttaccggcgaatctggcgcaggtctggtaaaagtgaccatcaacggtgcacacaactgccgtcgcgtagagatcgacccgagcctgctggaagacgacaaagagatgctggaagacctggtggctgcagcattcaacgacgcagcacgtcgtattgaagaaacgcagaaagaaaaaatggcctctgtatcctccggaatgcagctgccgcctggctttaagatgccgttctgatgcaaaccagcccgctgttaacacagcttatggaagcactgcgctgtctgccgggcgttggcccgaagtcggcgcagcgtatggcgttcacgctgcttcagcgcgatcgtagcggcgggatgcgtctggcgcaggcgctcacccgggcgatgtcggaaatcggccactgcgccgattgccgcactttcaccgaacaggaagtctgtaacatctgttcgaatccgcgtcgtcaggaaaacggtcaaatctgcgtggtggagagtccggcggacatctacgccattgagcagacggggcagttttcaggtcgttattttgtgttgatggggcatctgtcaccgctggacggcatcggtccggatgatatcgggcttgatcgtctggaacagcgtctggcagaggaaaaaatcactgaagtgatcctcgccaccaaccccacggttgaaggtgaagctaccgctaactacattgccgagctttgcgcgcaatatgacgtggaagccagccgaatcgctcatggcgttccggttggcggcgagctggaaatggtcgacggcaccacgttgtcacactcccttgccgggcgtcataagattcgtttttaagcaaacgagagcaggatcacctgctctcgcttgaaattattctcccttgtccccatctctcccacatcctgtttttaaccttaaaatggcattattgaggtagacctacatgaaaggacaagaaactcgtggttttcagtcagaagtgaaacagcttctgcacctgatgatccattctctctattccaataaagaaatcttcctgcgtgagcttatctctaacgcctccgatgcggcggacaagctgcgtttccgtgcgctctctaacccggacctgtacgaaggtgatggcgaactacgcgttcgtgtctctttcgataaagacaagcgtacgctgaccatctccgataacggcgtggggatgacccgcgacgaagtgattgaccatctggggactatcgctaaatccggtaccaaatcattcctcgaatccctgggttctgaccaggcgaaagacagccagctgatcggtcagtttggtgttggtttctactctgcgtttatcgtggccgacaaagtgaccgtgcgtactcgcgcggcaggcgaaaaaccagaaaacggcgtcttctgggaatcggctggcgaaggtgaatataccgttgccgacatcaccaaagaagatcgtggtactgaaatcaccctgcatctgcgtgaaggcgaagacgagttcctcgatgactggcgcgtgcgttccatcatcagcaaatactccgaccatatcgcgctgccggtagagatcgaaaaacgcgaagagaaagacggcgaaaccgttatctcctgggagaaaatcaacaaagcgcaggcgctgtggactcgtaacaagtcggaaatcaccgatgaagagtacaaagagttctacaaacacatcgcccacgactttaatgatccgctgacctggagccacaaccgtgttgaaggtaagcaggagtacaccagcctgctgtacatcccgtcccaggctccgtgggatatgtggaaccgcgatcataaacacggcctgaaactgtatgttcagcgtgtgttcatcatggacgacgcagaacagttcatgccgaactatctgcgcttcgtgcgtggtctgattgactccagcgatctgccgctgaacgtttcccgtgaaatcctccaggacagcacggtaacgcgtaacctgcgcaatgcgctgaccaagcgtgtgctgcaaatgctggaaaaactggcgaaagacgacgcggaaaaataccagaccttctggcaacagtttggcctggtactgaaagaaggtccggcggaagatttcgctaaccaggaagcgatcgccaaactgctgcgttttgcttctacccataccgattcttctgcgcagaccgtatctctggaagactacgtttcccgcatgaaagaagggcaggagaaaatctactacatcaccgcagacagctatgcggcagcgaagagcagcccgcacctggaactgctgcgtaagaaaggcatcgaagttctgctgctttccgaccgcatcgatgagtggatgatgaactatctgactgagttcgacggtaaaccgttccagtcggtgtctaaagttgacgagtcgcttgaaaaactggctgacgaagttgatgagagcgcgaaagaagcggagaaagcactgactccgttcatcgaccgtgtgaaagccctgctcggcgagcgcgtgaaagatgtccgtctgactcaccgtctgaccgatacgccagcgatcgtttcgaccgacgcggacgaaatgagcactcagatggcgaaactgttcgctgcggcgggccagaaagtgccagaagtgaaatacatcttcgaactgaacccggatcacgtactggtgaaacgtgcggcagatactgaagatgaagcgaagttcagcgagtgggtagaactgctgctggatcaggcgctgctggcagaacgcggcacgctggaagatccgaacctgtttattcgtcgtatgaaccagctgctggtttcctgatgtcatgccggatgacctttgtgtcatccggcatttttcttttcatcatctgcactttccgcaaattatctcgccattaaccgtttcagcctcaggtgcctttcttgaggcaatcgcctgttggtggtatcgtttatcgctttttcaaaaaattcgacacattttaaggggattttcgcaatgcgtatcattctgcttggcgctccgggcgcggggaaagggactcaggctcagttcatcatggagaaatatggtattccgcaaatctccactggcgatatgctgcgtgctgcggtcaaatctggctccgagctgggtaaacaagcaaaagacattatggatgctggcaaactggtcaccgacgaactggtgatcgcgctggttaaagagcgcattgctcaggaagactgccgtaatggtttcctgttggacggcttcccgcgtaccattccgcaggcagacgcgatgaaagaagcgggcatcaatgttgattacgttctggaatttgatgtaccggacgaactgatcgttgaccgtatcgtgggtcgccgtgttcacgcgccgtctggccgtgtttatcacgttaaattcaatccgccgaaagtagaaggtaaagacgacgttaccggtgaagagctgaccacccgtaaagatgatcaggaagaaaccgtacgtaaacgtctggttgaatatcatcagatgactgcgccgctgattggctactattcaaaagaagctgaagcgggtaataccaaatacgcgaaagttgacggcaccaagccggttgctgaagttcgcgctgatctggaaaaaatcctcggctaattcgaaagcgcgcacggacagtcccctcgccccctcggggagagggttagggtgaggggaacaggcccgcacaagcaaacttatcagcaatctcaggccggatattcattcggccttttacaaaaacctcaatctgcgctattcctttttctgatttgacctctcacagcaattagttcttcttcctcacttttccgctacaattatcaacaagttgaatcgataagaggcggtaatgcgtcagactaaaaccggtatcctgctggcaaacctgggtacgcccgatgcccccacacctgaagcggtaaaacgctatctgaaacaatttttaagcgacagacgcgtggttgatacctcacggttgttatggtggccattgctgcgcggcgtgattttgccgctgcgctcgccgcgtgtggcgaagctgtatgcctctgtctggatggaaggtggctcgccgctgatggtttacagccgtcagcaacagcaggcgctggcacaacgtttaccggagacgcccgtagcgctgggaatgagctacggctcgccatcactggaaagcgccgtagatgaactcctggcagagcatgtagatcatattgtggtgctgccgctttatccgcaatactcctgttcaacggtcggtgcggtatgggatgaactggcacgcattctggcgcgcaaacgtagcattccggggatatcgtttattcgtgattacgctgataaccacgattacattaatgcactggcgaacagcgtacgcgcttcttttgccaaacatggcgaaccggatctgctgctgctctcttatcatggcattccccagcgttatgcagatgaaggcgatgattacccgcaacgttgccgcacaacgactcgcgaactggcttccgcactggggatggcaccggaaaaagtgatgatgacctttcagtcgcgctttggtcgggaaccctggctgatgccttataccgacgaaacgctgaaaatgctcggagaaaaaggcgtaggtcatatacaggtgatgtgcccgggctttgctgcggattgtctggagacgctggaagagattgccgagcaaaaccgtgaggtcttcctcggtgccggcgggaaaaaatatgaatatattccagcgcttaatgccacgccggaacatattgaaatgatggctaatcttgttgccgcgtatcgctaaagctgagcggtaaagaactgagcgccgtcgcgaagagcctcgtcggcggttttcatcatccgtgaataatgcaaaaaggcgtgcagcgtgcctgggtagagtttgaactcacagggctgctgatgcgccgctaacgtctggtaaagcagacggctgtcatccagcagcggatcgaactccgccccggcaataaaacagggcggaacttcgcgagtgagatcattattaaacagacagtaatacggcgactcgcggtccgcgtcgttgcttaaatacgcctcttcatacatctgcaaatcctgttgcgttaagccatcccagacaccgcccaacagacgacgagtcacggaatcccgtaatccgtaaagcccataccacagcaaaacacccgcaattttaccgcaatcgatctgtttatcacgcaaccacaacgcactggcgagcgccagcatggcacctgcggaatcaccggcaaagccaatgcgggacatattgatttgataatcctccgcctgctggtggaaataacaacaagcagccacaatttcctctatcgcttgcggaaaacgcgcttcaggtgaaagggtgtaatcaataccaatcaccgtacattggctgtagcttgccagcaggcgcatgatgcgatcgtgggtatcgagattgccgagaataaaaccgcctccatgcaaataaaatagcgtcgccgggctatctggctgcggacaaaagagacgtgtttccacctgcccatattttgttggaaccatgtaagctctggttgccatttctggagcgcccgcattccagaatcggcgctcaagcgtgtaatactgtcgttgctcagcaatcgttcccgttgcgggccagggcggtaaatccggctgaagagtattcacaacggtcttcattccagcagaaataaggtccagaacaggtgatttgttttccggcttcatacaaaaactcctttcaaattacgtcattgtaaggaaccactgccatgaaaatgcgatcccgcctgctgatattgaaactggctgcgtctcgcgcgctcccgtcagattgtgttaacattcgccgctcagttaaccacccgtaaaaacaaccatgaaatttcccggtaaacgtaaatccaaacattacttccctgtaaatgcacgcgatccgctgcttcagcagttccagccagaaaacgaaaccagcgccgcctgggtagtgggtatcgatcaaacgctggtcgatattgaagcgaaagtggatgacgaattcattgagcgttatggattaagcgccgggcattcactggtgattgaggatgacgtagccgaagcgctttatcaggaactaaaacagaaaaacctgattacccatcagtttgcgggtggcactattggtaacaccatgcacaactactcggtgctcgcggacgaccgttcggtgctgctgggcgtcatgtgcagcaatattgaaattggcagctatgcctatcgttacctgtgtaacacctccagccgtaccgatcttaactatctacaaggcgtggatggtccgattggtcgttgctttacgctgattggcgagtccggggaacgtacctttgctatcagccctggccacatgaaccagctgcgggctgaaagtattccggaagatgtgattgccggagcctcggcactggttctcacctcttatctggtgcgttgcaagccgggtgaacccatgccggaagcaaccatgaaagccattgagtacgcgaagaaatataacgtaccggtggtgctgacgctgggaactaagtttgtcattgccgagaatccgcagtggtggcagcaattcctcaaagaccacgtctctatccttgcgatgaacgaagatgaagccgaagcgttgaccggagaaagcgatccgttgttggcatctgacaaggcgctggactgggtagatctggtgctgtgcaccgccgggccaatcggcttgtatatggcgggctttaccgaagacgaagcgaaacgtaaaacccagcatccgctgctgccgggcgctatagcggaattcaaccagtatgagtttagccgcgccatgcgccacaaggattgccagaatccgctgcgtgtatattcgcacattgcgccgtacatgggcgggccggaaaaaatcatgaacactaatggagcgggggatggcgcattggcagcgttgctgcatgacattaccgccaacagctaccatcgtagcaacgtaccaaactccagcaaacataaattcacctggttaacttattcatcgttagcgcaggtgtgtaaatatgctaaccgtgtgagctatcaggtactgaaccagcattcacctcgtttaacgcgcggcttgccggagcgtgaagacagcctggaagagtcttactgggatcgttaagttatcgtcggttcgtaggccagataaggcgttcacgccgcatctggcatttggctctcgatgcctgatgcgacgctggcgcgtcttatcatgcctacatatttttcatattttacatccggcaaccaccgtttaccccgtcaccacctcacccgccggtggcgtttccagcagttccagcatggtacgggcgatttcacgctcgcccatcactacctgattcgcaccacgttcggtgatatacgccacttcatcgtcataatgggcgcgggcaataatctcaatatccggatttttcgcgcgggcagatgccacaatctcacccgcttcataaccgttgggaatcgtcaggatcagccattttgcacattccagatgcgccagttgcataatttcttcgttcgccgcattgcccaatactgcgcggaccccgcgctctcgcagctcatcaacacgggttcgtgacgtctcaatcaccaccagcggaatatcagaggcgagcaatttctcccccagcaggctgcctacacgaccgtaacccaccagtagcgcatggttgcaaatatccactgggatctgcttctcttcttcgattgcctcttccagcgtctgctcttccagcgtttcggtcttcgccagatatttctccagtagtgcgaacagtaccgggttgagcataatcgacaggatcgcccctgccagtaccaggttttgtccggcctgcggcagtaaattcaatgccattcccagtcccgccaggataaacgcgaactcaccaatctgcgccaggctggcggcgatggttaatgccgtacgttgggagtgaccaaacagtcgcaccaggaaaaatgcggctaacgacttaccaaacagaataatcgccagcgtcgccagcactgccagcggttgctgaatcagaattaacggatcaaacaacatcccgacggagacaaaaaacagcaccgcaaacgcgtcgcgcaatggcagcgtatcgtgggcggcacggtgactcagttcagactcgttcagtaccatcccggcaaagaacgcaccgagtgcaaaggagacatcaaacagctctaccgcaccaaaggcaacccctaacgccagcgccagcaccgacagggtaaacagctcgcgagaaccggttgccgcgctgcgtgccataatccacggcaccagacggcgacctaccagcatcataatggcgataaatgcgatcactttgccgatggtgatccccatatcgactgcaagagtggcaaagcccacatcgccctgttccatcattcctgccactgcgggcagcaacaccagcgtcagaaccattaccaggtcttccacaatcaaccaaccgatggcgatttgcccacgctgactgtcaattaattgccgttcttcaagtgcgcgcagtaacaccacggtactggcggtggaaagacataaaccgaacacgataccggtcattaacgaccagcccagcacggcagagagcgccatacccagcagcgtcgccacggctatctgggcgatcgcaccgggaatggcgatggcctttaccgccatcaaatccttcagcgaaaagtgcaaaccgacgccaaacatcaacagaatgacgcccagttcagccagttccggcgcaagcttggtatcggcaacaaagcccggagtgaatggtcctgccagcacacccgctaacagatatcccaccagaggagaaatacgtagtttattggccagcatgccgaggataaaggcgagcacaaggccgccaacaatggtggtgataagcggggtggcgtgatgcattccgtctccttttcctggtggttattgtccatttttggccgggaaaaccaaaattacaggtaatagtttatgacaatttcattgatgatgttcatgaataattattgaattttgcagaaaaatggaattagctgcaaaaaaagcacggatcggaaaacagaaggcggtttaacagaggaaaggcttatggcgactgtaaaacgatgcagccaaagtttgcctttggctgcaatgaaatcagtctttatgccggttatcaggcaggaatatggtcaacatccccaatagtggcaggaaagcacagattttatagactaactcgatgctggtgtgatcggcgataagccccagaactgccgctcccagacctcccatgccaaaagcaaaaccgaaaaagagtccagaaaccataccgatacgtcccggaagtagctcctgagcgtagaccagaatggcagagaatgccgaagcgaggataaatccaataatcaccgttaaaacccccgtccagtgcaggctggcgtagggtaaaatcagcgtaaacggcgcaacgccgaggatagagccccaaatcacatatttccgtccaattttatcccctacaggcccgccgatcaccgtacctgccgcaacggcaaacaggaaggcaaacagatgaagctgggcattctggatagataatccgaatttttgcatcagataaaaggtgtaatagctgctgatgctcgccatatagaaatatttcgagaaaatgaggattaacagaatgctgactgccagtaccactttgttgcgcggcagtggattgattatcgtcgctttgggttttcctttattcattcggtgctgtgccgagtaccaacggctgatttgtgccaacaccacgatcgccagcagtgccgcaagcacaaaccaggcaacgttgcctttgccataaggcgcgataatcaccgccgccagcaagggtcccagggaactgccaaagttgccgccgacctgaaagatagattgtgccaggccatgccgcccgccggaagccatacgggccacgcgagaagattccggatgaaagaccgatgaaccggtaccgaccagcgccgccgccagcagaactgcgccaaaactgcccgccagcgcaagcagcaccagaccacttaaggtaaagcacatgccaattggcaacgaccacggcatcggatatttatcggtccagtagccgaccactggttgcagtagcgaagaggcgagctggaaggtgagggttatcatgccaatctgcataaatgtcagagaaaattctgactgaagcagcggataaatcgccagaatcagcgattggatcatgtcgttcagcagatgtgagaggctgatagcacctaaaataccaaacgatgttcgggccttggtcgttgacgcagccgcgcccgccacaggctggggttgttcactcattgccataggaaagtcactttttcagggttgcgatgtaaagaatgatcttatttgtgattattacccgactaacatacctgtatgcgtcgtctgaaggaagtctcaacgccgaatacagaatttctaatctggatgcagatttatcttcaccggacgcagacttgtctatgatgtcgcgtcatactatttttcaacacgttgaaatcaggtcagggagagaagtatgaaattattgcagcggggcgtggcgttagcgctgttaaccacatttacactggcgagtgaaactgctctggcgtatgagcaggataaaacctacaaaattacagttctgcataccaatgatcatcatgggcatttttggcgcaatgaatatggcgaatatggtctggcggcgcaaaaaacgctggtggatggtatccgcaaagaggttgcggctgaaggcggtagcgtgctgctactttccggtggcgacattaacactggcgtgcccgagtctgacttacaggatgccgaacctgattttcgcggtatgaatctggtgggctatgacgcgatggcgatcggtaatcatgaatttgataatccgctcaccgtattacgccagcaggaaaagtgggccaagttcccgttgctttccgcgaatatctaccagaaaagtactggcgagcgcctgtttaaaccgtgggcgctgtttaagcgtcaggatctgaaaattgccgttattgggctgacaaccgatgacacagcaaaaattggtaacccggaatacttcactgatatcgaatttcgtaagcccgccgatgaagcgaagctggtgattcaggagctgcaacagacagaaaagccagacattattatcgcggcgacccatatggggcattacgataatggtgagcacggctctaacgcaccgggcgatgtggagatggcacgcgcgctgcctgccggatcgctggcgatgatcgtcggtggtcactcgcaagatccggtctgcatggcggcagaaaacaaaaaacaggtcgattacgtgccgggtacgccatgcaaaccagatcaacaaaacggcatctggattgtgcaggcgcatgagtggggcaaatacgtgggacgggctgattttgagtttcgtaatggcgaaatgaaaatggttaactaccagctgattccggtgaacctgaagaagaaagtgacctgggaagacgggaaaagcgagcgcgtgctttacactcctgaaatcgctgaaaaccagcaaatgatctcgctgttatcaccgttccagaacaaaggcaaagcgcagctggaagtgaaaataggcgaaaccaatggtcgtctggaaggcgatcgtgacaaagtgcgttttgtacagaccaatatggggcggttgattctggcagcccaaatggatcgcactggtgccgactttgcggtgatgagcggaggcggaattcgtgattctatcgaagcaggcgatatcagctataaaaacgtgctgaaagtgcagccattcggcaatgtggtggtgtatgccgacatgaccggtaaagaggtgattgattacctgaccgccgtcgcgcagatgaagccagattcaggtgcctacccgcaatttgccaacgttagctttgtggcgaaagacggcaaactgaacgaccttaaaatcaaaggcgaaccggtcgatccggcgaaaacttaccgtatggcgacattaaacttcaatgccaccggcggtgatggatatccgcgccttgataacaaaccgggctatgtgaataccggctttattgatgccgaagtgctgaaagcgtatatccagaaaagctcgccgctggaggtgagtgtttatgaaccgaaaggtgaggtgagctggcagtaatccgaaagtgccggatgtttgcatccggcacaatgcttaatcgcggcgggcgatatcagcaaatttggcatcgaggatctttgccagatcgcctgccgccagttcgatatccagtccgcgcttgccgccggaaacataaatagtggcaaattcttgtgcgggggcgtcgataatcgttggcagacgttttttctgccccagtgggctaatccccccaaccaggtatcccgtcgaacgctgcgcgaccatcggatcggccatctcaactttcttggcacccagcgcttttgctacttttttaagatccagttgacctgcgaccggcgtaacggccacggcaaggtgtttcatatcaccgttcactgccaccagcagcgttttgtagacctgatccggattcaaacctaattttttgacgacttcatcgccaaaattggtttcagccggatcgtgctcgtaggtatggatttgaaacgaaatcttgtttttttcgagtaatttaactgcgggtgtcatggtaattttcctgccttaaacaaaaaaacgaagcaagcatacgcctgatggcggtccaaaaaaaagagtcatcttgcctaagagtattggcaggatggtgagattgagcgacaatcgagttacaccgtcgcttaaagtgacggcataataataaaaaaatgaaattcctctttgacgggccaatagcgatattggccatttttttagcgcaacatttgcggcaaattcccttctccatacaggtgtagtgcaccgaccgcgaccacatatcgccccggcggcatggcgcgtaatttatcccgccaggcgagatttcgctgatgcatcagcacatcgtacagcgactgactgaacgtattgggcagcgttatatcattattttgcggaggtgcattcagccaccagctcatcatttgttgcagcaaccgtgcgttggtatgccagtgggtcagcgtatcgtccagcagcgccagtcctttgtcagggagctggagcaacatggtaatctggttttcagccccttccagttcaatcacgggtttatgttgttgcttcgccgcctgcaataactggtaatcgataccgtattctgcccgcagccccagtttttgtgcctgcgtcgcctgaagaaccatcgcgatttgccacagcggttgagtagaaaagagcgacggagaaatgcccatctcctggctaatgtgctgcagattttggagttgctcctcgttaatgcgctcttccagcgcctcgcaagtaggcaaattagcaaaaggcgtatcgctggtggaaacatccgcctcgacgatcagcgcatcggcgtttttgagctttttgagcaaacgggtgggcaggggagccatatcgtggctacccatatgaatactgccaatcagatgaaaatggcgattgccgggaagggtgatatcgatggcaggccaggtgtaatgattaccgcgcagcgcggcccaaagcgtttttacccggtacaacagatccatacgacctccctttgtgaaatatcatgctagcgcgcggggagggatggcgcaaatggagttggggacttgtttaatgtgtttgtatgattcagtatgttcttgtatcgctattcacagggaagcaacagttaaaaactatgaaacaggcaacaagaaaaccgacgacacccggagatattcttctctatgaatatctggaaccgctcgatttgaaaatcaatgagttagcagagttgctgcatgttcatcgtaatagcgtcagtgcactgatcaataacaatcgtaaactcactactgagatggcatttcgtctggcgaaagtttttgataccacagtcgatttttggctaaacctccaggcggcggttgatctttgggaagttgaaaacaacatgcgcacccaggaagaattgggacggattgaaacagtggctgaatatttagcacgccgtgaagagcgtacaaaaaaggtcgcgtaaggccaaaacatcgcttcatctcggatgccggataaggcgttcacgccgcatccggcatccgagcaccattgcctgatgcgacgcttacgcgtcttatcaggcctacaaacctgtgcctgaaccgtaggccggagaaggcgtttacgctgcatccggcatccgagcaccattgcctgatgcgacgcttacgcgtcttatcaggtctacaaacctgtgcctgaaccgtaggccggataaggcgtttacgccgcatccggcatccgagcaccattgcctgatgcgacgcttacgcgtcttatcaggcctacaaacctgtgcctgaaccgtaggccggataaggcgtttacgccgcatccggcagtcatgcgtcgatgccaaatgcgccaccctaaagcagcgcatccgcaatgatgtacttattccttcggtttaaaccgcagcaaccggttggcgttactcactacggtaatcgacgagagcgccattgccgctccggcaactaccgggttaagcagtgttccagtgaacggccacaaaataccggcggcgaccggaataccgatactgttgtagataaacgcaccgagcaggttctgcttcatgttgtgcagcgttgcgcgggaaatagcgagcgcatccgcaacgcccatcaggctatggcgcatcagggtaatcgccgcggtttcaatggcaacatcactgccgccacccatcgcaatgccgacatccgcctgagccagcgctggcgcgtcgttaatgccgtcgcccaccattgccacctgacgtccttcactttgcagatgtttgatcgcttcggctttaccgtccggcagcaccccggcgatcacctcatcaatccctgcttctttggcgatcgcattggcggtggttgggttatccccggtcaacatcaccagacgatatcccgctttatgcaggcgttgcagcgccgccacgctatcactacgcaatggatcgcgtacagccagcagggctactgctttcccgtcaatcgccagcagcacaggcgttgctccttgcgatgcctgagctgaaatatcggcttcaatcgctttagtatcgacttgctgatcatttaacaacgcctgattgcccagcaataacgcatgaccttcagcttcaccgctcacgcccagcccgcgcaatgtgcggaaaccgttgacctgcggtagctgcatatcgcctgctttatcgaggatcgctcgtgccagcggatggctggaaccttgttccagtgccgccgccagacgcaatgcctgcgcttcatcaacatcagcaaatgttttcactgcgacaacctgcggcttcccttcggtcagcgtcccggttttatcgaacacgacggtatcgagtgtactggcgcgttgcagcgcgtcggcgtcccgcaccagcacgccaaactcagccgcccgcccgacgccggaaataatcgacatcggcgtcgccagccccagcgcacacggacaggcgataatcagtaccgtggtggcaatcaccagggtataaacaatttgcggtgccggaccaaagaagtaccagattgccgcactgaccagcgcaatcaccaccaccacaggtacaaatacggctgagattttatccgccagctgaccgatttctggcttgctgctctgggcctggcgcaccatgcgaatgatccgtgacagcgtggtatggctgccaaccgcactggcacgaaacagcacactgccgtcctgtaccactgtcccggcatggacgctttcgccttcgcctttttgctgtgggattggttcgcccgtcagcatcgcttcatccagccatgcttcgccctgggtaatctcgccatctaccggcacgcgatcgccggtcgtcaggcgcagtaacatccctggctgaacttccgccagcggcacgcttttttcaccctctgcggtgaccactcgcgccgtcggtggggttaaatcgagtaatttctccagcgccttagaagaacgctgacgtgcgcgcgcttccagcatatggccgagattaatcagaccgataatcatcgcactggcttcatagtaaagatgccgcgcttccatcgggaaccactgcggccacaggttgacgctcatcgaatagagccacgccacacccgttcccagcgccaccagcgtatccatcgtcgctgcaccgttcagcaggcttttccatgcactgcggtaaaaatggccgccggcgaaaaccatcactgccagggttatcaggccgataactaaccacaagctgcggttgtcagcggtgaccatcatgttatcgccgatcatcccccagaccattaccgggatacccacagccagtgcaacaattgcctgccagcggaagcgcttcatcgtagctacggcggtttcttgctggcgctcgcggcgtttagcgtcatcttcaatcgcttccgcaccgtagcccgctttttccaccgcctgcactaaatcttgtggggaggcactgcccatcaccagcgcagtacgctccgccaggtttacccgtgcctgagtgacgcccggtacgctttgcagcgcattttgtacgcgggtgacacagctggcgcagctcatgccgctcagcagcaactgctggctgtcatcgtcatcggcggtcgctgccggaagcgcctcagaaaccgctgtcagtgcttccgacgggattgatgactccgccagcggtttagcctttgggtggcttacagatgcgtcataacccgcttgtttgatggtttcgatcagctgttctgcactggcagtcccggtaacgtgcgcttcagtgatagacacatccgcctgctcaacatccgggcgctgttcaagactttctttcacgcgtttaacgcagtgaccgcaggacaggccgtccagggtcaggtcgatagtttgtgacataaaacactcctttaagacagttttgactggctgtgataaaggttaaaccttccagcaaggggaaggtcaagaaattaataaaccaggcgagtaaaagtccgtaaagattaaaaaattggctcaatttgcatcaggattagacatttatctctttgttttcctgtagttaagttgcgggtgctaagttaaatcaggatgcctgaaaatcggcaccggggtgaggaattacctcccgcatctataaaaaggagttaacaaaagatgttagatgcaaacaaattacagcaggcagtggatcaggcttacacccaatttcactcacttaacggcggacaaaatgccgactacattccctttctggcgaatgtacctggtcaactggcagcagtggctattgtgacctgcgatggcaacatctatcgcgcgggtgatagtgattaccgctttgcgctggaatccatctcgaaagtctgtacgttagcccttgcgttagaagatgtcggcccgcaggcggtacaggacaaaattggcgctgacccgaccggattgccctttaactcagttatcgccttagagttgcatggcggcaaaccactgtcgccactggtaaatgctggcgctattgccaccaccagcctgattaacgctgaaaatattgaacaacgctggcagcgaattttacatatccaacagcaactggctggtgagcaggtagcgctctctgatgaagtcaaccagtcggaacaaacaaccaacttccataaccgggccattgcctggctgctgtactccgccggatatctctattgtgatgcaatggaagcctgtgacgtgtacacccgtcagtgctccacgctcatcaatactgttgaactggcaacgcttggcgcgacgctggcggcgggtggtgtgaatccgctgacgcataaacgtgttcttcaggccgacaatgtgccgtacattctggccgaaatgatgatggaagggctgtatggtcgctccggtgactgggcgtatcgcgttggtttaccgggcaaaagcggtgtaggtggcggtattctggcggtcgtccctggcgtgatgggaattgccgcgttctcaccaccgctggacgaagaaggcaacagtgttcgcggtcaaaaaatggtggcatcggtcgctaaccaactcggctataacgtgtttaagggctgatcatgatgaacacggaaggtaataacggtaacaaacctctcggtctatggaacgtcgtttccatcggcattggggcaatggtgggggcggggatcttcgcgctgctggggcaggctgcattgctaatggaagcctcgacctgggtcgcctttgcttttggcggtattgtggcgatgttttccggttatgcctatgcgcgtctgggggcgagctatcccagcaatggcggcattatcgacttctttcgtcgcggattaggcaacggcgtcttttcgctggcgctctcgttactgtacctgttgacgctggcggtgagcatcgccatggtcgcccgtgcttttggcgcttatgccgtgcagtttttgcatgaaggcagccaggaggagcaccttattttgctctacgcgttggggatcattgcggtgatgacgcttttcaactccttaagcaaccatgcggtagggcggctggaagtgatcctcgtcggcattaaaatgatgatcctgttattgctgattattgccggtgtctggtcgctgcaaccggcgcatatttccgtctctgcgccccccagctccggtgcgttcttctcctgtattgggataactttccttgcctatgcgggctttggcatgatggcgaacgcggcggataaagtgaaagatccgcaggtcattatgccacgggcgtttctggtggcgattggcgttaccacgttgctttatatctcgctggcactggttttgcttagcgatgtatcggcattagagttagaaaaatatgccgataccgccgtagcgcaggctgcttctccgctgctcgggcatgtgggttatgtgatcgtcgtcatcggcgctttactggcgacggcttcagccattaacgcgaacctgttcgccgtgtttaacatcatggacaacatgggcagcgaacgcgaactgccgaagctaatgaataaatccctgtggcggcagagtacctggggcaacattattgtcgtggtgttgattatgctgatgacggcggcactgaatttaggctcactcgccagcgttgccagcgccacctttttgatttgctacctggcggtgtttgtggtggcgatccgcctgcgtcatgatattcacgcctcgttgccgattcttatcgttggtacgttggtgatgttgttggtgatcgttggctttatctacagtctgtggtcccagggtagccgtgcgttgatatggattattggctcactcttactcagccttattgtggcaatggtcatgaagcgcaataaaaccgtataacatctctctgtgcgcagtacttcctgtattattgtggtggcggtcgatattcgcactggcaaaaaaacgtgcttgaatatctgttgaaaccctttaacaaagcacaggaggcgttgcgcgaacgatgaacatcagcgatgtagcaaaaattaccggcctgaccagcaaagccattcgcttctatgaagagaaggggctggtgacgccgccgatgcgcagcgaaaacggttatcgcacctacacgcagcagcatctcaacgaactgaccttactgcgccaggcacggcaggtgggctttaacctggaagagagcggcgagctggtgaatctgtttaacgacccgcagcggcacagcgccgacgtcaaacggcgcacgctggagaaggtggcggagatcgaacgacacattgaggagctgcaatccatgcgcgaccagctgctggcactggcgaatgcctgccctggcgatgacagcgccgactgcccgattatcgaaaatctctccggctgctgtcatcatcgggcagggtgattaagacgagacggctcggatatgtagggttatcccttctatcgcaatgacttcaacatgcgtacctgcaccgagatcctcgctggcgctgacaggccatgaactgtcaccgacgcgcatatgaccgcgcccgttgaccagcggagattccagcacaaaacgtcggccaatcagctgctgcccgcgctggtttaaatgactatcgctgtgcttttgttcgcgcacccgccgcgacaaccatttccaccacagccaggcggcgagcagcgtcaggatggcaaacattaccccttgccactcccaacccagcggcaccagccagaccaccaggccggtaatcaccgctgccacgccgctccacaacaaataaccatttccgcccagcatctcggctgccagcagcaaaccgccgagactgagccagaaaatatgtggatgaacgaccattaactccatcatggctgagtccgtttgttggcgctgtctttcaccagctcggcaatcccggcaatcgaccccatcaggctgctggcctctaatggcatcatcactactttgctgttactggaggaaccgatctgctgtaacgcttcggtgtatttctgcgctacgaagtagttcaccgcctgaatatcaccggaggcgatagcttcagacaccattttggtggcgcgggcttctgcttcggcggaacgttcacgcgcttcagcctgtaaaaacgccgactgacgttcgccttccgctttcaggatttgcgactgtttttcaccttcggctttgaggatttccgcctgacggatcccttccgcttcaagaatgtaagcgcgtttggtacgttccgctttcatctgcgcgttcattgaagagataagctctgccggtgggcgcacgtcgcgaatttcaatacgggtgactttaatcccccacgggttggtggcttcatcgacaatacgcagcaggcgtgagttgatgctgtcgcgctgagagagcatttcgtcaagttccattgaacccaacacggtacggatgttagtcatggtcaggttgatgatcgccagctccagattgctgacttcataagccgcgcgcggcgcgtcaatcacctgaataaaacagactgcgtcgatggtaacgttggcgttatctttcgagataacttcctgggaagggatatcgagcacttgctccatcatattgatcttgcgaccaatgcgatccataaacggcaccaccagactgagccccggctgtaacgttttggtatagcgaccaaaacgttctaccgtccattgatagccctgcggcacgattttgacgcccgcgccgacaatgaccagcgcgacaaaaatgagaatcgggataaagataagcatcggaaaaacctcctgttgtaccgtccataatcagcaaaattgctgcttgattaaacaaattatacctgattactgaaagagagttcccccttattcctgcgaaggataaactgtttttagtaaaaatcagaaaaagggaacagcgatgcaggaaaatagtcctttgcttcagctacaaaacgtaggatatctggcgggtgatacgaagattcttaataacatcaatttttcgctgcgtgctggcgaatttaagttaattaccggtccttctggttgtggcaaaagtacgctgctaaaaatagttgcttcattgatcagcccaaccagcggaacgttactgtttgaaggggaggatgtcagcacactaaagccagaaatctaccgccagcaagtctcttactgcgcccagacaccgacgctgtttggcgatacggtatacgataatctgatctttccctggcagatccgtaaccagcagcctgacccggccatttttctcgattttctcgaacgcttcgctttgccggacagcattttgacgaaggatatcgccgagctatctggtggtgaaaaacaacgcatctcattgattcgtaacctgcaatttatgccgaaggttttattgctggatgaaataaccagtgcgctggatgaaagtaataaacataacgtcaatgagatgatccatcgttatgtgcgcgagcaaaatattgccgtgctgtgggtgacacacgataaagacgaaattaatcatgcggataaagtgattacactgcaaccgcatgccggagaaatgcaggaagcacgctatgaactcgcataatattactaacgaatcattagcactggcattaatgctggtggtggtggcaatcttaattagccataaagaaaaactggcgctggagaaagatattctctggagcgtcgggcgagcgataattcagctgattattgtcggctatgtgctgaagtatattttcagcgtggatgatgccagcctgacattattgatggtgttatttatctgctttaatgcggcgtggaacgcgcaaaaacgcagtaaatatattgctaaagcttttatctcatcgtttattgccattacggtcggggcgggaattaccctggcggtgctgattctctcagggtcgattgaatttatcccgatgcaggtgatccctatcgccgggatgattgccggtaacgccatggtagcggtggggttgtgttacaacaatttagggcaacgggtcattagcgaacagcaacagattcaggagaaactgagtcttggcgcgacgccgaagcaggcttcagcgatattgattcgcgacagtattcgcgcggctttaattccgacggtcgattcagcaaaaacggttggcttagtgagtttaccaggaatgatgtccgggctgatatttgccgggattgatccggtgaaggcgattaaatatcagattatggtgacctttatgctgctctcaaccgccagcttgtcgaccattattgcctgctatttaacctatcgtaagttttataattcgcgccaccagttggtggtgacgcaattgaagaagaaatgatgcgatgccggatgcgcagcatcgcatccggcgttgtggttcatgtgccgatcaacggaatatcaatacaacaatgcatacagctggcggcgatacttcgacgccagtgcatcacccgtacccagcgcagcgaggatctcctggaacgttttacgcgtctgaccgtctgcggcggtgagatctttacgcagatgcccgaacagcaactccagcgcctcttcattgcgcccaacctgatgcagttgcagcgccagttgcgtcgccagtgcggcatcttctggattctccgccacctgctgttgcaactgttgaatttccggcgtatcagccgcctgcttcagcagttcgatttgcgccaccagcccctggtagcgggtgtcctgatcctgcaacggaatggttttcagcaccgcttccgcatcttcagaacggttcagcgcaatcagcgtttctgccagcagcaggccgatctccccgttctgattcgacaactgccaggcgtctttcagcaatggcagggcatcggtgtaattgccttcctgcatcagttgcatcgcctgctgcgctttcagctcttcttcgcgcggcagcactttatccagcagggcgcggatcgcctcttccggttgcggcccctggaagccatctaccggttgcccgttctggaacagatacacggtcggaatcgcgcgcagaccaaactgggcggcaatcatctgctccgcgtcgcagtccagcttcgccagaataaattgcccgttgtactgcgccgcaaggctttccaggatcggggttaactgcaaacagtgctggctacgttcagaccaaaaatagaacagcaccggagtggtcatcgactgttcaagaacctgttgcaggttagattcgttaatgttgacaatattttctacggacatggagtcgctctctgttgtcgatattttctttgacatgggggcttaagcgcgcgcttcaactcacccctgcaatattttgtccatcacgcgccccggcagcaggcgcttgagcaccattactgcccaggtcaccagcgttaccggatagcgcatcttcggcttctcgctaataaaagcatggcgtactttgtccaccaccgcttccggtcccaacgtaaagcgggcggcgatgccgggattttcgactggtttatcactttgcgtctggttgacgttgtcggtgaagcgagtacgaatgggaccgggttcgatcaggctgactttaattccgctgtggcgcagctccatgcgcagtgcgtctgaccacgcctccagcgcatatttactggccgcgtaagcgccacgacccggcgtggagattaatcccatcaccgatgatgtcatcacaatacgcccttcaccgtgcggtaacatcgcgggtaacaggcgcatggtgagctggtgtgcgccgaaaaagttggcggaaaactgctgttccatctgcgcacggctgatggtggaaagggggccatacatgccgaatccggcattgttaaagatcccatacagacaattatcggtcagggcgatcacttcgtcggctgcgcgatcaacactttctggcgaatccagatcgatcaacacgccggtaaatcccatgctgttcatacgctcaacatcatccggtttccggcaacctgccagcacatgaaaaccctggcgttttaattcgagcgcgctttccaggccaattccactggaacatccggtaattaagaccgatttttgcataactttacctgtcaggatctccgttgctttatgagtcatgatttactaaaggctgcaactgcttcgccatccagtcggcaataaacggctgggcgtcgcggttgggatgaataccgtcatcctgcatccattgtggcttgaggtagacctcttccataaaaaagggcagcagcggaacatcaaactctttggcgagtttggggtaaatggcgctaaaggcttcattataacggcgaccatagtttgcaggcagacgtatttgcattaacaatggttcagcgttggcggctttgacatcctgcaaaatctggcgcagcgtttgctcggtttgctgtggctgaaaaccacgcaaaccgtcattgccgcccagttcaaccagcacccaacgcggctgatgctgtttcagcagagccggaaggcgcgccagtccttgttgcgaggtgtcgccgctgatgctggcattaactaccgacgttttactctgccacttatcattcaacaaggcaggccaggccgcgctggcagacattcgatacccggcgctcaggctatcacccagaatcaataacgtgtccgctgcggcggcacggaaggttaacaggaccaggaacaggaagggcaaatgccagcggaaaacattgttgaagttcatcatcttaagaagtccgtcggtcagggggagcatgaactctccatcctcaccggagttgagctggttgtcaaacgtggcgagaccatcgcactggtgggcgagtcgggatcgggtaagtcaaccttgctggcgatcctcgccgggcttgatgacggcagcagtggcgaagtgagtctggtgggacaaccgctacataatatggacgaagaagcgcgggcaaagttgcgcgcgaagcacgtcggctttgtttttcagtcatttatgttaattcctacccttaacgcgctggaaaacgtcgagcttccggctctgctgcgcggtgagagtagcgcggaaagtcgtaacggggcgaaagcgttgctcgaacagttagggctgggtaaacgtctggatcatcttccggcacagctttccggcggtgaacagcaacgagtggcgctggcacgagcctttaatggtcgacctgatgtgctgtttgccgacgaacccaccggcaaccttgaccgccagacgggcgataaaattgccgacctgctgttttccctcaaccgtgaacatggcaccacgttgattatggtgacccacgacctgcaactggcggcacgctgcgaccgctgcttacggctggtgaacgggcagttgcaggaggaagcatgattgcacgttggttctggcgcgaatggcgttcgccgtcgctattaattgtctggctggcgctaagcctggcggtggcctgcgtgctggcgctgggcaatatcagcgatcgcatggagaagggcttaagccagcaaagccgtgagtttatggcgggcgatcgggcgttgcgcagttcacgcgaagtgccgcaagcgtggctggaggaagcgcaaaagcgcggcctgaaagtcggcaagcagctgactttcgccacaatgacctttgcaggcgacacaccgcagctggcgaacgtcaaagcggtggatgatatctacccgatgtatggcgatctgcaaactaatccccctggcctgaaaccgcaggcgggcagcgtattgctggccccacgcctgatggcactgcttaacctgaaaacgggcgacaccattgacgtgggcgatgccaccttgcggattgccggagaagtgattcaggaaccggattccggttttaaccccttccagatggctccgcgtctgatgatgaatctggcggatgtcgataaaaccggagccgtgcagccggggagtcgggtcacctggcgttataaattcggcggcaacgagaaccagctcgacggctatgagaaatggttgttacctcagcttaaacccgaacaacgctggtacggtctggaacaggacgaaggcgcgctggggcgatcgatggaacgctcgcaacagttcctgctgctttcggcgcttctgaccttgctgctggcagtggcagcggtggcggtagcgatgaatcattactgtcgcagtcgctacgatctggtggcgatcctcaaaacgctgggggcagggcgagcgcaactgcgtaagctaatcgtcggtcagtggttgatggtgctgacgctttcagccgttaccggtggggccataggtctgttgttcgaaaacgtgttgatggtgctgctcaagcccgttctgcctgctgcactaccgccagccagcctctggccgtggctgtgggcgcttggcaccatgacggtcatctcgctgctggtggggctacgaccatatcgcttgttgctggcaacgcagcctttacgcgtattacgtaatgatgtggtagcgaacgtctggccgctgaagttttatctgccgattgtcagtgtggtggttgtgctgctgctcgccggattaatgggtggcagcatgctgctttgggcggtgctggcgggcgcggtagtactggctttgctgtgcggtgtgctgggctggatgctgctgaatgtacttcgccgcatgacgctgaaatcgctgcctctgcgcctggcggttagccgcctgttacgtcagccgtggtcaacgttaagtcagctttcggcattttcgctctcctttatgctgctggcgctgttgctggtattgcgtggcgatctgctcgaccgctggcagcagcagctaccgccagaaagcccgaactactttttaattaacatcgccacagaacaggtagcaccgctaaaagcgttcctcgcggaacatcatatagtcccggaatcattttatccggtagtgcgggcgcggctgacggcgattaacgataagccgacagaaggtaatgaagatgaggcgcttaatcgcgaactcaatcttacttggcaaaatacgcggcccgatcataatccgattgtcgccggtaactggccgccaaaagccgatgaagtgtcgatggaagaggggctggcgaaacgcttaaacgttgccctcggtgataccgtgacttttatgggcgatacccaggagttccgcgctaaagtgaccagcctgcgcaaagtggactgggaaagtctgcggcctaatttctattttattttcccggaaggggcattagacgggcaaccgcagagctggcttaccagtttccgctgggagaatggcaacggcatgttgacgcaactcaaccgccagttcccgaccattagcctgttagatattggcgcgattttaaaacaggtcggtcaggtgctggagcaggtaagtcgggcgctggaggtgatggtggtgctggtcaccgcctgcggtatgttgctgttgctggcacaggtgcaggtgggaatgcgccagcgtcatcaggagctggtggtatggcgcacactcggtgcggggaaaaaactgctgcgcacgacattgtggtgtgagttcgccatgcttgggtttgtttccggcctggtggccgcaattggtgcggaaacggcactggcagtgttgcaggcgaaagtgtttgatttcccgtgggagccagactggcgattgtggattgttctgccgtgcagcggtgcgctgctgctgtcgcttttcggcggctggctgggcgcgagactggttaagggtaaggcgctgttcaggcagtttgcggggtgatgacaggtgttagattgcctgatgcgctacgcttatcaggcctacgaagagcgtgcaatatattgattttgcaagattgtgtaggccggataaggcgtttacgccgcatccggcatgaacagtgtgcattttggcaataaatatgaaaccaactgtcatgtcggtttttttaaagaccgaaggtggtaaaccttcggccttagctacgtttcctcagttattcaataaactgacggatcagttccagcagcgcgattagcgccttaagaacgatgagaactttatcgagaaaagttttcatccgttgctcccttaagggagaaagacaatcacagcttacccttacgttgcctgtaactatgattttcttcatgtgctagatgaggactgcctctctccaaattagagcaccagaatcagcaccacctgtatcctgaccaggacttaaaagtacttttccgcactgcggtaatcccttgaggcagtatcactactagcgtcgggattgtatcgccaacatagctgtttgaatatgtaggcatcctgacttataattcacttgctagatgaggactgtttcatttctgcccggaaccaccaagtcttgggcggaaaaaataaaaaaaccgactgtcatgtcggtttttttatatctgtattctggtgcaaccattctgttctcacgacaatcgccgtttcagaataccgcccatcactgcgccttaacccattccgccacttccgcccactcaccgcgaaagacaactttttccgcttttttctcaagctgatagcgatacattgggtcgtaatattctttaagtaacggcaccagccaggccagatgaccgtcggtgctgccggtggtgagttgcgttgtcagcgccgtatccagctgggcagcgagttcgttatagcgctgtaaccccagccgacgcttaatcgccgaaagtccgtgatgcaggtattcgcaatattcctgccagccctgttcgtcgccataagcgtgggtaaaatcatgatgcatacgcaagaaatactcttcgttcaggcgttcaagacggatctcaaacggatcttctaccaccgcaatcgccgcctgagtcattcgctcgcgcagacattccggcaggtgattcgaaccgatcatccggctttcgtcttccagcacccacaggcgcaaattctgacgggcgtcggtttttagcatttcggcagccagcaggttttcaaaactcgcctggctaagttgtggttgtaacgtgcgaccaaacgccgaaccgcgatgacgcgccaacccttccagatcaacaccgttcggctgttgctgcactaacagcgttttaccgctgccggtacaaccgccaatcagcactatcggtttttgtgccagttcaatagtcgcctgaatcgcggtctggcgcagtgccttataaccgccttccaccagcggataatcaatccccgctgcatgcaaccagctttgcacaatatgtgagcgctgaccgccacgggcgcagcagagaataccttgcggattttgcaggcacgctgcccgccaggcgtccatgcgctgctgacgaatttcacccgcaaccagtttatgtcccagcgccagcgctgcgtctgagccttgctgtttatagcaggtgccaacggcggcgcgttcatcgttattcattaacggcagattgatagcggcgggcattgcgccttgctcaaactcgataggggcgcgaacatcaataatgggcgtatcagcaatcagcagggcacgatagtcctgttccgtgtgtctctcttgcatagttaaaagtgaacctcaaatcagcttgcgcgctattttacgcgccaacgcgcaaggaaacttgatttttaactgcgtgggttgccgaaaatttctaaaaatccgctgatttccggcctgcgctgggtaaacaaggtcacaatatcttctaccgctttgccgctgccaaatttgcgccatgccagactcaatggcgaaggagggcgcatcgttgggattacccggctgaccagttgttgattatcgatcattgactggcaaagcgattttggcaaaaaaccaatgccaacgcccgccagatgggcggcgattttcgtttccatatcgggaacaataatctctttttgccctggcaatcgccaggcgacgcgtttggttaaggtgcgggcgctgtcttcaatattgaccgccggaaagcgccgcaactgcgcttctgttagcggctcttcaacgttcgccagcggatgatccgccgccatgacaaagcgccattgcaccgatcctaagggatcaagactaaaggtatttgccagcgcctcagttcccgtgacgccgatagccagcgaaaaaccttcgtacaatagcgagtcccagacgcccatatagatttgtcgggagatgtgaaactgggtaaaggggtaacgctcattcagccacgccagcaactgggcgacggcctgggggttgtagagcaggttgttgatgacaatattcacctggcgttccacgccatcattcacctgttgcagctcgcttggcatactttccagccagctcagccagtctctggcctgggaaagtagatgctcgccagccgctgtcaacgtcacgctgcgagtcgtacggaaaaacagcgctactccggtattctcttccagaagtttaatgcgataactgatcgtcgccgtggttttacataatcgttctgccgcttttgaaaaacctcctgtttcagcaaccgcaatgaaagtccgcaaggtttctggatcgaacatcttcaggtatccccttttaaatccgcaagttgcgtgattttcttatcctctgatttatcagtatttttacatgataaccctgttcaatttgtggactaaatctagttttggaaaaatattccaacttttgtattgatgttgttctcttaaggttttagattgcctgttattgaaaccaagctgaccggtcggcggtggttgaacggaattatgttacaaggacaaaaagatgaaacttcaggtattaccgttaagtcaggaagcctttagtgcttatggcgacgtaatcgaaacgcagcaacgggattttttccatattaacaatggcctggtggagcgttaccacgatttggcgctggttgagattcttgagcaagaccgtacgcttatcagcattaaccgcgcgcaaccggcgaatctgccgctgaccattcacgaactcgaacgtcatccgctgggtactcaggcctttatcccgatgaaaggtgaggtgtttgtggtggtcgtggcgttaggtgacgacaaaccagacctgtcaacgctgcgggcgtttatcaccaacggcgaacagggagtgaattaccatcgtaacgtctggcatcacccacttttcgcctggcagcgcgtcaccgattttctgaccatcgatcgcggcggcagtgacaactgtgatgttgaaagtattcctgaacaggaactctgttttgcgtgacgcctgcaaccgacttgcataagataaactaattgttcattgtttatgctcacttgtaggtcggagttaacgtaggtatgacggaagttagacggcgcggcaggccaggacaggcggagcctgtggcacagaagggcgcacaggcgttagagcggggaattgcgattctgcaatatttggaaaaaagtgggggaagttcgtcggttagcgatatttctctcaatctggatttgccgctctccacgacctttcgcttgctgaaggttttacaggcagcggattttgtctatcaggacagtcaattaggctggtggcatataggattaggtgtctttaacgtcggtgcggcgtacatccataaccgcgatgtcctctccgtcgccgggccgtttatgcgccgcctgatgttactttccggcgaaacggtcaatgtcgcgatccgtaacggcaatgaagcggtattaattggtcagttagagtgtaaatcgatggtcaggatgtgtgcgccactgggcagtcgtctgccactgcatgcttccggtgcgggcaaagcgctgctttatccgctggcggaagaggagttgatgagcatcattctgcaaaccggtttgcagcagtttacgccaactacgcttgtggatatgcccaccttgctgaaggacctggaacaagcgcgtgaactgggctataccgtagataaagaagagcatgttgtaggtctgaattgcatagcttcagcaatttacgatgatgtcggtagtgttgttgccgctatctccatctccgggccttcatcaagactgacagaagatcgttttgtcagtcagggtgagctggtcagagacaccgcccgcgatatcagcacggcgttgggactgaaagcacatccataatgtctgtcgcatcccgctctgcggagcgggtttttttgacaaaatttgaaagttggaaaaattttccaataaatagaggtaggaataaaatggcaaaaatgagagccgttgacgcggcaatgtatgtgctggagaaagaaggtatcaccaccgccttcggtgttccgggagctgcaatcaatccgttctactcagcgatgcgtaagcacggcggtattcgtcacattctggcgcgtcatgtggaaggtgcttcgcacatggcggaaggttatacccgcgcaacggcaggaaatatcggcgtatgtctggggacttccggtcctgcgggcacggacatgatcaccgcgctctattccgcttctgctgattccattcctattctgtgcattaccggccaggcaccgcgcgcccgtctgcataaagaagattttcaggccgtagatattgaagcaattgctaaaccggtcagcaaaatggcggttacagttcgtgaagcggcgctggtgcctcgcgtgctgcaacaggcatttcacctgatgcgttctggtcgtccgggtccggtactggtggatttaccgttcgacgttcaggttgcggaaatcgagtttgatcctgacatgtacgaaccgctgccggtctacaaacctgctgccagccgtatgcagatcgaaaaagctgtagaaatgttaatccaggccgaacgtccggtgattgttgccgggggcggggtaattaatgctgacgcagctgcactgttacaacagtttgctgaactgaccagcgttccggtgatcccaacgctgatgggctggggctgtatcccggacgatcatgaactgatggccgggatggtgggtctgcaaaccgcgcatcgttacggtaacgcaacgttgctggcgtccgacatggtgtttggtatcggtaaccgttttgctaaccgtcataccggttcggtagagaaatacaccgaagggcgcaaaatcgttcatatcgatattgagccgacgcaaattggccgcgtgctgtgtccggatctggggattgtctctgatgctaaagcggcgctgacactgctggttgaagtggcgcaggaaatgcaaaaagcagggcgtctgccatgccgtaaagagtgggttgctgagtgccagcagcgcaaacgtactttgttgcgtaaaacacacttcgacaacgtgccggtgaaaccgcagcgcgtgtatgaagagatgaacaaagcttttggacgtgatgtttgctatgtcaccaccattggtctgtcgcaaattgccgctgcgcaaatgctgcatgtctttaaagaccgccactggatcaactgtggtcaggctggtccgttaggctggacgattccggctgcgctaggggtttgtgccgctgatccgaaacgcaatgtggtggcgatttctggcgactttgacttccagttcctgattgaagagttagccgttggcgcgcagttcaaaattccgtacatccatgtactggtcaataacgcttatctggggctgattcgccagtcgcagcgcgcgtttgatatggactactgcgtgcaactcgctttcgagaatatcaactccagcgaagtgaacggttacggcgtcgaccacgtaaaagtagcggaaggtttaggttgtaaagcgattcgcgtcttcaaaccggaagatattgcgccagcctttgaacaggcgaaagccttaatggcgcaatatcgggtaccggtagtcgtggaagttattctcgagcgtgtgaccaatatttcgatgggcagcgaactggataacgtcatggaatttgaagatatcgccgataacgcagcggacgcaccgactgaaacctgcttcatgcactatgaataagggagataaataatgttacgtttctctgctaatttatcgatgttatttggagaatatgattttctcgcccgttttgagaaagctgcgcagtgtggttttcgcggcgttgaatttatgtttccttatgactacgacattgaagaattaaaacaggtgctggcgagtaataaactcgaacatacgctgcacaatctaccggcgggtgactgggcggcgggggagcgcggtattgcctgtattcctggccgtgaagaagagtttcgggatggcgtagcagcagcgattcgttatgcccgtgcgctggggaataaaaaaattaactgtctggtcggtaaaacgccggctggtttcagcagtgaacagattcacgcaacgcttgtagaaaacctgcgttatgccgcgaatatgctgatgaaagaagatattttattactgattgaacctattaaccattttgatattcctggtttccatctcaccggaactcggcaggcgctgaaattgattgatgatgttggttgctgcaatttgaaaattcagtatgacatttatcacatgcagcggatggaaggtgaattaaccaacaccatgactcagtgggccgataaaattggccacctgcaaattgctgataatccgcatcgcggcgaaccggggaccggagaaattaattatgattatctctttaaggtaatcgaaaattctgactacaacggttgggttgggtgtgaatataaaccccaaaccaccacggaagccggtttacgctggatggatccgtaccgttaaaacgtaacgctgttcaggcaatgcttttttaggccgctaagttggcaggggatcgtgttgtctgaattcaggaaaagcgaaatttaaaagaggttaattatgaaactgggatttattggcttaggcattatgggtacaccgatggccattaatctggcgcgtgccggtcatcaactgcatgtcacagccattggtccggttgctgatgaattactgtcactgggtgccgtcagtgttgaaactgcgcgccaggtaacggaagcatcggacatcatttttattatggtgccagatacaccacaggttgaagaagttctgttcggtgaaaatggttgtaccaaagcctcgctgaagggcaaaaccattgttgatatgagctccatttccccgattgaaactaagcgtttcgctcgtcaggtgaatgaactgggcggcgattatctcgatgcgccagtctccggcggtgaaatcggtgcgcgtgaagggacgttgtcgattatggttggcggtgatgaagcggtatttgaacgtgttaaaccgctgtttgaactgctcggtaaaaatatcaccctcgtgggcggtaacggcgacggtcaaacctgcaaagtggcaaatcagattatcgtggcgctcaatattgaagcggtttctgaagccctgctatttgcttcaaaagccggtgcggacccggtacgtgtgcgccaggcgctgatgggcggctttgcttcctcacgtattctggaagttcacggtgagcgcatgattaaacgcacttttaatccaggtttcaaaattgcgctgcaccagaaagatctcaacctggcactgcaaagtgcgaaagcgctagcgctgaacctgccaaacactgcgacctgccaggagttatttaatacctgcgcggcaaacggtggcagccagttggatcactctgcgttagtgcaggcgctggaattaatggctaaccataaactggcctgatacccgcaataaaaatggccgatatcagaaaatgaatcggccagcaatattaaaaaagaaagcagccaaagatgttgcttcagtattaaaaataatatttttattttatttgttcctcatagctagattaaaacaacgttattcgatacgtgaaattaagagggatttatggaacatcagagaaaactattccagcaacgcggctatagcgaagatctattgccgaaaacgcaaagccagcggacctggaaaacatttaactattttaccttatggatgggttcggttcataacgttcccaattatgtgatggtcggcggcttttttattctcggcttgtctacctttagtattatgctggcaattatcctcagcgcctttttcattgccgcggtaatggtattaaacggtgctgcgggcagtaaatacggtgtgccttttgccatgatcctgcgtgcttcttacggtgtacgtggtgcactgtttcccggattattaaggggcggaattgccgccatcatgtggtttggtttgcaatgttacgcggggtcactggcctgcttgattctgattggcaaaatctggccgggatttttaactctcggtggtgatttcactctgttaggcctttctctaccgggcttaattactttcttaatcttctggctggtcaacgttggtataggttttggcggtggcaaagttttaaataaattcactgccattcttaacccgtgcatctatatcgttttcggcggtatggcgatttgggcgatttcactggtcgggatcggtccaatctttgactacattccgagcggtattcagaaagcagaaaacggtggcttcctgttcctggtggtgattaacgcggtagttgcggtctgggcggcaccggcggtgagcgcatccgactttacgcaaaacgcccactcgtttcgtgagcaggcgctggggcaaacgctgggtttagttgtggcctatattctgtttgcggtcgccggggtatgtattattgccggagccagtattcactacggcgctgatacctggaacgtgctggatattgttcagcgttgggacagcctgttcgcctcgttctttgcggtactggttattctgatgacaactatctccactaacgcgaccggtaatattattccagccggttatcagattgccgccattgcaccgacaaaactgacctataaaaacggcgtactgattgccagtattatcagcttgctgatctgcccgtggaaattaatggaaaatcaggacagcatttatcttttcctcgatattatcggcggaatgcttggtccggtaattggtgtcatgatggcgcattattttgtggtgatgcgcggacaaattaatcttgatgaactgtatgccgcacctggcgattataaatattacgataacggttttaacctcactgcgttttcagtaactctggtggccgttattttatctcttggcggtaagtttattcactttatggaaccgttatcgcgtgtttcatggtttgtcggcgtcatcgtcgcctttgcggcctacgccttattaaagaaacgtacaacagcagaaaaaacaggagagcaaaaaaccataggttaattaatcccgatattgaacattgagttaaaaaccaatctgtattttacaaggagtttgttatgtcttttgatttaatcattaaaaacggcaccgttattttagaaaacgaagctcgcgttgtagatatcgccgttaaaggcggaaaaattgctgctatcggtcaggatctgggcgatgcaaaagaagttatggatgcgtctggtctggtggtttcgccgggcatggttgatgcgcacacccatatttctgaaccgggtcgtagccactgggaaggttatgaaaccggtactcgcgcagcggcaaaaggtggtatcaccaccatgatcgaaatgccgctcaaccagctgcctgcaacggttgaccgtgcttcaattgaactgaagttcgatgccgctaaaggcaagctgactatcgatgcggcacaactcggtggcctggtgtcttacaacattgatcgtctgcatgagttggatgaagtgggcgttgtcggcttcaaatgcttcgttgcgacctgtggcgatcgcggtatcgacaacgacttccgtgatgtaaacgactggcagttcttcaaaggtgcgcagaagctgggcgaactggggcagccggtgctggtgcactgcgaaaacgcgctgatctgtgatgcactgggcgaagaagcgaaaagtgaaggtcgcgtaactgcccatgactatgtggcttcgcgtccggtatttaccgaagtggaagcgattcgccgcgtactgtacctggcgaaagttgccggttgccgtctgcacatttgccatatcagcagcccagaaggtgttgaagaagtgactcgtgcacgtcaggaaggtcaggatgttacttgtgaatcctgcccgcattactttgtactggataccgatcagttcgaagaaatcggtactctggcgaagtgttcaccgccgatccgcgatctggaaaaccagaaaggcatgtgggaaaaactgtttaacggtgaaatcgactgcctggtttccgaccactcaccatgccctccggaaatgaaagccggcaacatcatggaagcatggggcggtattgccggtctgcaaaactgtatggacgtgatgttcgatgaagcggtacagaaacgcggaatgtctctgccaatgttcggcaaattaatggcgactaacgcagcagatattttcggtctgcagcaaaaaggccgtatcgccccaggaaaagatgccgagttcgtcttcattcagccgaatagcagctatgttcttaccaatgacgatctggaatatcgccacaaagtcagcccgtatgttggccgtaccattggcgcgcgtatcacgaaaaccatcttacgtggtgatgtgatttacgacattgaacagggcttccctgttgcgccgaaaggtcaatttatccttaaacatcagcagtaatctggcccctgcaatgcccgtccttgcggcgggcattctccggttaaggtgtgtttatgttcaattttgcagtcagccgcgaaagcctgttatcaggatttcagtggtttttctttattttttgcaacacggttgtggttcctcctacgctactttctgcttttcagttgccgcaaagtagcctgcttacgctcacgcaatatgcttttcttgctaccgcactggcctgcttcgctcaggcgttctgcggtcatcgtcgcgctattatggaagggccgggtggcctgtggtggggaaccatccttactatcacccttggcgaagcatcgcgcgggacaccgatcaacgatatcgctaccagtctggcggtggggattgcactctccggcgtgctgacgatgttgattggttttagcggattaggccatcgcctggcacggttatttacgccgtcggtgatggtcttgtttatgttgatgctgggcgcgcagctgaccactatctttttcaaaggtatgctcgggctgccgtttggcatagccgacccaaattttaaaattcagttaccaccgttcgcgctctcggtggcggtgatgtgcctggtactggcgatgattatctttctgccgcaacgttttgcccgttatggcctgctggtcggtacgataaccggctggttgttgtggtacttttgctttccttcttcgcattcgctctccggtgagttgcactggcagtggttcccgctcggcagtggcggtgctttgtcgccgggaattattctgacggcggtgattacaggtctggtgaatatcagcaatacctacggtgcgattcggggcacggatgttttttatccgcagcagggcgcggggaatacgcgttatcgtcgtagctttgtggcgaccggatttatgacgctgataaccgtaccgctggcggtaattccattttcaccgtttgtttcatccattggtttattaacccagactggcgattacacgcggcgttcgtttatttatggcagcgttatttgcctgctggtggcgctggttccggcactcacacgactgttttgcagtatccctttacccgtgagtagcgcggtcatgctggtttcttatctgcctttactcttttccgcgctggtgtttagccagcaaataacctttaccgctcgcaatatttatcgactcgcattgccgttatttgtcggcatatttttaatggcattaccgcctgtgtatctgcaagaccttccattaacgctgcgtcctctgctcagtaacggcttattggtcgggattttactggctgttcttatggataatcttattccgtgggaacgcatcgaataatttgttgaaaaaggattgataatgaagattgtcattgcgccagactcttttaaagagagcttaagtgcagaaaaatgttgccaggcaattaaagccgggttttcgaccctctttcccgatgcgcactatatctgtttgccgatagcggatggcggcgaaggaacggtggatgcgatggtcgccgcgacgggcggcaacatcgtgacgcttgaagtctgcgggccgatgggcgaaacagtgaatgctttttatggccttaccggcgacgggaaaacggcggtgattgagatggcggcagcaagtggcctgatgctggtcgcgcctgaaaagcgtaatccgttgctggcctccagttttggtacgggggagttaattcgtcatgcgctggataacggcattcgccatattattctcggcattggcggcagtgcgacggtcgacggcggtatgggcatggcgcaggcgctcggtgtgcgtttccttgatgccgacggtcaggtgctggtggctaacggcggtaatttagcgcgcgtggcaagcattgagatggatgaatgcgatccgcgtctggcgaattgccatattgaagtagcatgtgacgttgataacccgctggtaggggcacgcggcgcggcggcggtgtttggcccgcaaaaaggggcaacgccggaaatggtcgaagagctggaacaggggctgcaaaattacgcccgtgttttacaacagcaaactgaaatcaacgtctgccagatggcgggcggcggcgctgcgggcggtatgggtattgcggcggcggtatttctcaatgcggatattaaaccaggtattgagattgtgttgaatgcggtcaatcttgcgcaggcagtgcagggcgcagcactggtgattaccggggaagggcgcatcgactcgcaaacggcaggcggtaaagcgccgctgggtgtggcgtcggtggcgaagcagtttaatgtaccggtgattgggattgctggcgtattgggtgatggcgtggaagtggtgcaccagtatggcattgatgcggtattcagcattttgccacgtctggcacctttagccgaagtactcgccagcggtgaaatcaatctcttcaacagcgcgcgaaatattgcctgcgccattaaaataggtcagggaattaaaaactgactcttgcctttaaagcggatgctatttatttcgtataagagcgcagtactcatgccggatgcggcataagtactatatccttcctgaaaatcgcgcaaattctatatattgcagagatcatgtaggcctgataagcgaagcgcatcaggcaatgttacaaaaaaagccacgatataaaccgtggcaaaatccaacatagctaaaaataatcaggcgagtggtatgacttaaatctctacgtcgcggttgcaatctttcgagtaaatatagctgaacgcttcaccacgccctacaccataaccagcctgtaaagaataagcgcccataaagatgtaatcgccttttttcaccgggatccagttattgtcgaggttataaaccccctgaccggaaagaatataggcaccgtgttcctgaacatgtgtttcgatataaccgtggctggcacttggtgcaaaagagaggatatgcatgttcatatcaaaacctaactctttgggcagaaaatccagcaggatcacatcatccataccttcatagtgaatgcgttccagttcgctggcattgccagaaaccagccacggtgcatggccttctaccggaacatagcggcgcttatataaaaagatttggctgtcttcggcctgggcgttaacaaacgtcattaaggagcctggcgggcaataaagatagccaccttcgcttaaggcaaatgttttgccttcggctttggcagtgatatttccagtgatcacatacaggaacgtttcaatgccttcgccaccgaagccctgttggttgccgccgttttgatgcagtgtgaccagataatcaacaaaagaggcacccagctttggcgtggagaggattgtcgcgtcacaattttcaaagcccggaataatattttttaccagaccgtccggggttaacagtgcgaaattaccgtgtttcacaatcgcacggttagccagtaaatcatcgcggtaaccggtgacgttatttaaatatcccatttatgactccttatttctgccaggcaagttgataaagcatgagtgccaacgttttgaccccttcggcaaggtcggtaatattggtgcgttccgccgggttatggctgatcccgttgatgctgggaatgaaaatcatgcaggtcggcacgcgaggcgcgaaaatttgcgcgtcgtgcccggcaccactgtgcatcacccggtaattcagtttttcactttcacacaattctgtcagggtggcgaccaggtccttattcatcggcacgggttcttcgtccatccataaatcgatatcaataccaatgtccatttcatcgcaaatcgcccgcatgtcgttttctaactgttgggtgaaatcacgcagcacggcggcgtcggtatgacgacaatcaatggtgaacgtggttttacccggcaccacattcaccgtattcgggcgcggctctactttcccaaaggtcagaaccagcggatcgcccatctttttcgctttttcgatcgactgatggcaaatgcgactgaaagcgtaaaccgtatcacgacgataacccatcggcgtggtgcctgcatggtttgattcgccgttcagcgtcaccgtatagcgacgttgcccgacaattgcattcaccacgccaattgattgcccattactttccagcacacagccctgttcgatatgcagttcgacaaaggctttaatatcctgacgcggagttagcggggcgtccggcagagtaaatccgcaagccttcatcgcatcgacaaaactatttcctttggcatcacagatattccgcacgtcgtcaggattcgccagcccaaagatatttttactgccccagaagacatacgggaagcggctgccttcttcttctgccatcgccaccacttcgaccgtacgtaacggtgcgccgtattgcgttttcagccagtcaattgccagccacgccgccagcgcgccgaattgcccgtcgaggttaccgccgttaaccacggtatcgatatgcgaaccgctcagaatcacttcctgtggatattcggtaccattcaggcgaccgtataaattccctacttcatcgaaacgtgtttccagcccacttgctgccattctttttttaaattgctgctgggtttccagccattccggcgaataaagtaaacgggtcatcccacccgttgggtcagcgccaaaagaggaaagccagggcagcgcttcttctatggcttgacgaaaatgtgtaatcataagaaagtcctgtctcaataattattgcgcaaagggatttttcgtttcgtatgacgtgttataaagcgcgtcggaaattaaatactggtaaatatcatcaacaatttcgatgccttcgacggcggctttgcgttgtttaatatcctgatcctgtccgggataataaacttggttaaaaccgggcgcgggggtaatggcatttaattcgcgcatggtctggctaagatgttgacggaataattcgctggaggagaaaaagttcgggttaataactaaatgtaattgccccaaattacgcccggcgtgtaaatcgtcatacatcgaactaacctgtcgcccgaacggtaagccgagtaagacgcctgagaggacgtcaatcatcatcatcaggccataccctttcggcccggcggcggggagcagagcatgtaccgcgaacggatcggttgttggtgcaccgtttttatcgaccgcccaggtatccgggatagacatattacgcgagcgggcgtcgagcacttttccccatgcctgtacggtagtcgccatatcaaaggtaaggatctcgtcgccttctcccggcgcggcaaaggccagtgggttagtaccgtagtaaatttccgcgccgccaaacggcaccaccattggatcggactggcacatcgaaatgccaattaatccggcgcgggctgcctgctgcacaaaataagagattgcgccgctgtgacccatccggctgataccgaccaccgcaacgccattttgctgggcggttttgatggcatgttccatacccattttcgccgcgacctgtccggcggcattgtcggcatgtaaaattgccgagcacggcccggtttcctcaagacgaaactccggttcgcggttggtgccgccttttgaaatgcgttccgcgtagtattccacgcgcaccgcgccatgagagtggatccctctggcatcggcgtaaaccaatacttcagccacggttgcagcgtgctcacgttttaacccagcctggcagagtttattctcaattagctggtggagtgtttcccgactgattttcatctgtcttcctttttaacgacggtgtgaagcatgactgcaattaacatacagggaaaatatctggattatgtgatccagacaggcaaaaaaatatagttagaatttatttgataatccgctcgcttttaacctggtttttaaaacaaccacgcttattaaaaaataacacgtaatagcatggcggttatttgaattcttttgttaataatccctgtgtgatattcatcaccttatttacccgttgtcatcgataccgtaatcgccacattaacactgctcgtgcaattgccatgggtgcaatttttaaggagttgttatgatccacgcctttattaaaaaagggtgttttcaggattcggtcagtttaatgattatttcacgaaaactcagcgaatcagaaaatgttgatgatgtttccgtaatgatgggtacgcccgccaataaagcgttattagataccacaggtttctggcatgacgattttaataacgccacgccgaacgatatttgcgtggcaattcgtagcgaagcggcggatgcggggatcgcgcaggcgattatgcagcagcttgaagaggcgctaaaacaactggcgcagggggcaggcagcagccaggcgttgacgcaggtgcgtcgctgggacagtgcctgtcagaaattacccgacgccagtctggcgctgatttcagtggctggtgagtatgcggcggagctggcgaaccaggcgctggatcgcaacctcaacgtgatgatgttctccgataacgtcacgctggaagatgaaatccaacttaaaacccgcgcgcgggaaaaaggcttgctggtgatggggccggactgcggtacatcgatgattgccggcacgccgctggcttttgctaacgtgatgccggaaggcaacattggcgtcattggcgcttccggtaccgggattcaggagctgtgctcgcagattgcgctggcaggggagggaattactcacgcgattggccttggcgggcgcgacctcagccgtgaagtaggcggcatcagtgcgctgacggcgctggaaatgctcagtgcagacgagaaaagcgaagtgctggcatttgtttcaaaaccgcctgccgaagctgtgcgtctgaaaattgttaatgccatgaaagcaaccggcaaaccgacggtggcgctgtttttaggttataccccggcggtggcccgcgacgagaatgtctggtttgcctcctcgctggatgaggccgcacgcctggcttgcctgctttcacgtgtcacggcgcgacgtaacgcaatagcgcctgtcagcagcggatttatttgcggtttgtataccggcggtacgctggctgccgaagcggcgggattacttgctggacaccttggcgtggaagccgacgatacccatcatcacggcatgatgctcgacgccgatggtcaccagattattgacctcggcgatgatttctacaccgtcgggcgtccccatccgatgatcgacccagccttacgcaaccagttaattgccgatctcggcgctaaaccgcaagtgcgcgtattgctgcttgatgtcgtgattggcttcggtgcgaccgccgatcctgccgcctcgctggtaagcgcctggcaaaaagcatgtgccgcgcgttcagacaatcaaccactgtatgccattgccacggtgacaggcactgaacgtgacccgcaatgccgctcgcagcaaatcgccacgctggaagatgcagggatcgcggtagtgagttcgctgccggaagccaccttgctggcggcggcactgattcgtccgctttcgcctgccactcagcaacacacaccgtcattactggaaaacgtcgccgtgattaacatcggattacgcagctttgcgctggagctacaaagcgccagcaaaccggttgtgcattaccaatggtcgccagtcgccggcggcaataaaaaactggctcgtttattagaacgtttgcaataaggggttcccatgtttacatcagtagcgcaagccaatgctgcggttatcgaacaaattcgtcgcgctcgtccacactggctggatgtgcaaccggcttcttcacttatcagcgaactaaacgagggcaaaacactgcttcacgccgggccgccaatgcgctggcaggagatgaccggacccatgaaaggggcgtgcgtgggcgcatgtctgttcgaaggctgggtgaaagatgaagcgcaggcgctggcaatactggagcagggggaagtgaacttcattccttgtcaccatgtgaatgccgtcggtccaatgggcggtattacttctgccagtatgccgatgctggtggtcgagaacgtgaccgacggcaaccgggcgtactgcaacctcaacgaaggtatcggcaaagtgatgcgttttggcgcttacggcgaagatgtcctgactcgccatcgctggatgcgcgatgtgttaatgccagtattaagcgcggcgctggggcgcatggagcgcggtatcgatctcacggcgatgatggcgcagggcattacgatgggcgatgagttccatcaacgcaatattgcttcctctgcactgttaatgcgtgcgctggccccacaaattgctcgcctcgatcatgataaacagcacatcgccgaagtgatggatttcctcagcgtgaccgatcagttcttcctcaacctcgcgatggcttactgcaaggcggcgatggatgctggcgcgatgatccgcgcaggcagcatcgtcacggcaatgacccgcaacggcaatatgttcgggattcgggtaagcgggctgggcgaacgctggtttactgcgcctgtaaacactccgcaaggtctgtttttcaccggcttctcgcaggagcaggcgaacccggatatgggcgatagcgcgattaccgaaacctttggtatcggaggtgcggcaatgatcgcagcgcctggcgtaacgcgctttgtcggtgcgggtggcatggaagcggccagagcggtatctgaagagatggcggaaatttaccttgagcgcaatatgcagttgcagatcccaggctgggattttcagggcgcgtgcctgggactggacattcgtcgcgtggtagaaaccggcattacgccactcatcaataccggtatcgcccataaagaggcggggatcgggcagattggcgcaggcactgtgcgggcaccgctggcgtgttttgaacaggcgctggaagcactggctgaaagcatggggattggttgaggaacgcgcaatgacgatcatccatcctctgcttgccagtagtagcgcaccgaattatcgccagtcctggcggttagcgggagtgtggcggcgggcgattaacctgatgacggaaagcggcgaactgttaacgctgcatcgtcagggtagtggtttcggccccggaggatgggtgcttcgccgcgcgcaattcgatgcgttatgcggtggattatgcggcaatgaacgaccacaggttgtggctcaagggattcgcctcgggcgtttcacggttaaacagccacagcgttattgtttgctgcgtattacgccgcctgcgcatcctcaaccgcttgcagctgcatggatgcaacgcgcggaggaaaccgggcttttcgggccactggcgttggcggcaggcgatccgctgcctgctgagttacgccagtttcgtcactgttttcaggccgcgctcaatggcgttaagaccgactggcggcactggctgggtaaaggccccggattaacgccaagtcatgatgacacgctgagcggaatgctgctggcggcctggtattatggtgctttagatgcgcgctccggtcgccagttttttgcctgttccgacaatcttcaactcgttaccacagcggtgagcgttagttatttacgttatgccgcgcaaggatatttcgcctcgccactcctgcactttgtccatgctctgagttgcccgaaacgtaccgctgttgcgattgattcgctgctggcgctggggcatacgtcaggggcagatacactgctggggttctggcttggtcaacaattattacaaggaaaaccatgaaaacactggttgtagctcttgggggcaatgccttgcttcagcgcggtgaggcgctgacggcagaaaatcaatatcgcaatatcgccagtgctgtacctgcgctggcgcgcctggcccgttcttatcggctggcgattgttcacggcaacgggccgcaggtggggctgctggcgttacagaatctggcgtggaaagaagtggaaccgtatccgctggatgtgctggtggcagaaagtcaggggatgattggctatatgctggcgcagagtttgagcgcacagccgcagatgccgcctgtcacgacggtgctgacgcgcattgaagtttcgcctgatgatccggcgtttttgcagccagagaagtttatcggtccggtctatcagccagaagaacaagaggcactggaagcagcttacggctggcagatgaaacgtgatggtaaatatttgcgccgggtggtggcgtctccgcaaccgcgtaaaattctcgacagcgaagccatcgagttgttgctcaaagaggggcatgtggtgatttgcagtggcggcggcggtgtgcctgtgacggaagatggggcagggagtgaagcggtgattgataaagatctcgctgctgcgttgctcgctgagcagattaacgccgatgggctggtgatcctcactgatgctgatgcggtatatgaaaactggggaacgccgcagcaacgcgccattcgccatgccacaccggatgagttagcgccatttgccaaagccgatggttcgatggggccgaaggtaacggcggtgagtggttatgtcagaagccgtggtaaacccgcgtggattggggcgttatcgcgaattgaagagacgctggcgggcgaagcggggacctgtatttcgctgtagtgatgagagcatccagcaatcggtgcaccatgcctgatgcgacgcttgacgcgtcttatcaggcctacaatgggtaccggatcggtgtaggccggataaggcgttcacgccgcatccggcaatcaaatgagcaccaggttaactgaacttactctgtgcccacatcacgccgctggcatattccggcggcagcagcgggattaaggcttccagcgtcgcggacagacgcgatgtgtcgctgtcggtcaaattcagatgccccactttacggcccggacggacttctttgtcgtaccagtgcagatgcaccagcggcagtttcagccagtcataattcacatcgctaccaatcagattgatcatcaccgacggattattcaccactggttgcggtaacggcagatcggtaatcgcccgcagatgcagctcaaactggctgatgctggcaccgttttgtgtccagtgaccgctgttatgcacacgcggagccagttcgttgatcagcagaccttgcggggtgacaaaacactccatcgccatcacgcccacatagcccagctcctgcataatcgccgacagcatctcttcggcttgcgcctgctgctgtgcgttggcctgcggaaaagcgacgctggtgcgcaaaataccgtcctgatgcaggttatgcgtcagcggataaaacacggtgctgccatcaaagccgtgcgcgccaaccagcgacacttcaccagagaagttaatgccctgctcgacaatacattcgccgtaacactctgccggtaactgttcggtttcatttgcgcgtaaacgccattgaccgcgaccgtcataaccaccagtgcgacgcttaacaatcgccagctcacctaaacgatcaaacaccgcaggccactcgctgcgttcggcaagtaactgccacggtgcagtcggcaggtggagcttatcgaaaagctgcttctgagtcagacggtcagcaataatcgggaacacatcgcggttcacaaaggccggatggcgcgccagctcgcgggttaatgcggtttccggccagcgttctatctcagcggtaatcacgctttgttgaaaaggcaccgccgccggttcagcgtccagcccgactggccagacagcaatgcctaacggttcgcctgcctgacgcagcatacggcctaactgcccgttaccgaggacgcaaacctgtttcatgccgcacctcgcgggtccgggttttccagcacttcgtcggtctgggctttgcgccagtcattcagacgctggtgcagttctttatcatgagtcgcaagaatttgtgctgccagtaacgccgcgtttgccgcgccagctttaccaatcgccagcgtacccaccggaatgccgcgcggcatttgtacgatggagtagaggctatcgacaccgctcagtgcggcgctctgtactggcacgcccagcaccggcaccagcgttttggcggcaatcatgcctggcagatgcgctgcgccgcctgcgcccgcaataatcacctgataaccgttctcttcggcgctttcggcgaagctgaacagtttatcgggggtgcggtgagcagaaaccacttcaacgtggtgcgggacattcaggatttcgaagatttcggcggcgaactgcatggtagcccagtcgcttttggaccccatcacgatggcgacacgcgccggattattgcgggaagacatgcgtcttaaaactcctgtggtgcacaactctcggctttagagggcacagagaatagcacggaaagagagcaaggaaaacggttgcgtggctgtgaaatcagcaaagttgcgggttttttaaaacggaaaatgaatcagctcaacgtcatccgccgtgactttcaccattgaaccttccgtatgccaggcacccagtaccacgcgaaaagcaggttgctgattggcgataagttcatgcaccgccgggcgatgggtatgcccgtggatcagccattgcacctgatgtttttccatcgcactgaccaccgcgttttggttaacgtccatgatcgccagcgatttactgctgttggcttctttgctgttcgcgcgcattcgcgcggcaatgcgtttgcgcacaaacaacggcagggcgaggaatagcgtctgcagccagggtttgtggaccttggcgcgaaaagcctgataacccgcgtcatcggtgcacagcgtgtcgccatgcataatcaacacccggcgaccataaagttcgagcaccttttcttccggcaataacgtcatgccactttcacgggcaaagcgtttgccgagcagaaaatcacggttgccatgaatgaaataacagggaacgccggaatcggacaccgctttgatcgccgccgccatcttgcgatggagtgggttgggatcgtcgtcgccaatccatgcttcaaacagatcgccaagaatatacagcgcgtcggccttgcgggcttcccccgctaaaaaacgcagaaaaccggcggtgatcgccggttcttccacgcagagatgaagatctgcaataaagagtgtcgccacgattactcgctaacggtcacgctttcaatgataacgtcttcttttggcacgtcctggtgcataccgctacgaccggttgcaacacctttgattttgtctaccacgtccatgccgtcaaccacttcagcaaacacgcagtagccccaaccttgcaggctttcgccagagaagttcaggaagtcgttatcaaccacgttgatgaagaactgtgcagttgcagagtgcggagcctgagtacgtgccattgccagcgtaccacgggtatttttcaggccgttgttggcttcgtttttgatcggttctttggtggctttttgtttcatgcccggttcaaaaccgccgccctgaatcataaagccgttgataacacggtggaaaatggtgttgttgtaaaaaccttcgcggcagtagtccaggaagtttttaactgtttcaggtgctttatcgtcaaaagttttgatgacaatatcgccgtgattggtgtggaaagtaaccatttttgcatcctgttccgtttgattggtgcttcaacccagttcgggtcatatatagggtggtgttatagcataaccgcacgatcggatcatcacgcaatgtatgctgattcgcgcgggaaatatgggtattatacgcaactcaattacccacacatgtctaaacggaatcttcgatgctaaaaatcttcaatactctgacacgccaaaaagaggaatttaagcctattcacgccggggaagtcggcatgtacgtgtgtggaatcaccgtttacgatctctgtcatatcggtcacgggcgtacctttgttgcttttgacgtggttgcgcgctatctgcgtttcctcggctataaactgaagtatgtgcgcaacattaccgatatcgacgacaaaatcatcaaacgcgccaatgaaaatggcgaaagctttgtggcgctggtggatcgcatgatcgccgaaatgcacaaagattttgatgctttgaacattctgcgcccggatatggagccgcgcgcgacgcaccatatcgcagaaattattgaactcactgaacaactgatcgccaaaggtcacgcttatgtggcggacaacggcgacgtgatgtttgacgtcccgaccgatccaacttatggcgtgctgtcgcgtcaggatctcgaccagctgcaggctggcgcgcgcgttgacgtggttgatgacaaacgcaacccgatggacttcgttctgtggaagatgtcgaaagagggcgaaccgagctggccgtctccgtggggcgcgggtcgtcctggctggcacattgaatgttcggccatgaactgcaagcagctgggtaaccactttgatatccacggcggcggttcagacctgatgttcccgcaccacgagaacgaaatcgcgcagtccacctgtgcccatgatggtcagtatgtgaactactggatgcactccggaatggtgatggttgaccgcgagaagatgtccaaatcgctgggtaacttctttaccgtgcgcgatgtgctgaaatactacgacgcggaaaccgtgcgttacttcctgatgtcgggccactatcgcagccagttgaactacagcgaagagaacctgaagcaggcgcgtgcggcgctggagcgtctctacactgcgctgcgcggcacagataaaaccgttgcgcctgccggtggcgaagcgtttgaagcgcgctttattgaagcgatggacgacgatttcaacaccccggaagcctattccgtactgtttgatatggcgcgtgaagtaaaccgtctgaaagcagaagatatggcagcggcgaatgcaatggcatctcacctgcgtaaactttccgctgtattgggcctgctggagcaagaaccggaagcgttcctgcaaagcggcgcgcaggcagacgacagcgaagtggctgagattgaagcgttaattcaacagcgtctggatgcccgtaaagcgaaagactgggcggcggcggatgcggcgcgtgatcgtcttaacgagatggggatcgtgctggaagatggcccgcaagggaccacctggcgtcgtaagtaattgcgctattgccggatgcgagttttcgcatccggttatcgtctgcgccaccacaacattcccatcagtagcatccccggcaaccacacccacatcaattcagaaataatcacctgatgcccgtacggcgtggtgtaacgagacaatgcaaacggcgcgacttttatcacctgccagggagcgaaaaagcgttcatctgaccacggccacagccagccaacgcctttaccgccagtggttaccgaatccagcaagctgtgcgatagcaacgagacggttaaaaacagccagcagcgaatcagcccagccctgaaccatcggcgtccaataaacacacataacagcgggacaacaaacgcaaacaccagcgaatgggtaaacccgcgatgaccaaaaacattgccgtaagcaacgccaaatttaaacgacaatacgtcggcgtcgggcagcatcgccaggatgattccggcaaataacagacgcggagggatgactttcgaacccaaccctaaaccaatgcataggggaacggcggcgtgcgtaataacggttggcatgatggtcgcttcggcaaaatgtcgatgctatcagcatggatgaacggggcgtagagggcaaaagtctgaaaagagaaccggcctgttgatacaggccgggaaagggatcaggcaacaacctgtacgctgtgacctgcaaaactcactgtctgaccggcgacgattttgcagcgtttgcgcgtttcaaccgcaccgtcgactttcacctggccttcggaaatcgcgattttcgcctgcgcgccgctttcgctccagccttccagtttcagcaaatcgcacagctcaacgtgcggatgtttacctaaagaaaatgtcgccatgttactcaccctgtggatcatgatattcaacgcacgcctgaagcgtgttttcaatcagcgtggcaaccgtcatcgggccaacgccgcccggaacaggcgtaatgtatgaggcgcgtttagccgcgtcttcaaacacgacgtcgcccacaactttgccattttccagacggttgatgccgacatcaatcacaattgcgccttctttgatccagtcaccaggaataaagcccggcttgccgacggcaacgatcaacagatcggcattttctacgtggtgacgcagatttttagtgaaacggtgagtcacggtagtggtgcaacctgcgagcaacagttccatgctcattggacgaccgacgatattcgatgcgccaatcaccacggcgttgaggccgaaggtatcaatgttgtaacgctcaagcagcgtgacgataccgcgcggggtgcagggacgcagacgcggcgcgcgctggcacagacgaccgacgttataaggatggaaaccgtccacgtctttgtccggatgaatacgttccagcactttgacgttatcaatacccgccggtaacggcagttgaaccagaatgccatcgatggtgttgtcggcattcagcgcatcgataagctccaacagctccgcttcgctggtggtttccgggaggtcataagagcgggagacgaacccgacttcttcacaagccttgcgtttgcttgcgacataaatttgcgatgcagggttactacccaccagcacaacggccagtcctggtgcccgcagtccggctgcaatacgcgcctgaactttttgagcaacttcagagcgcacctgctgcgcaatcgttttaccgtcaataatctttgctgccatcagagagaggattccatctgttacgtaggtcgaaggggatgcgcctattttgtcagaagcggggcgcgctgtcaggtttcgtttcagatttatcgcgtgaagcgacctcttgcgaaggtgaggcgcaccgtcgctgaggtcgctgagattgaaagcttcatttttcgtccatgatggcgttgtaaatctggaactgatttatttccttgtttaaggattaagataatttaagaaatacctgacaatataaaaagaattttcagcctggtaatttaccgcttcaggtctatatttgtgttgaatatattttgcgcgaaagtattcatctaacggggctctctattttttagaatagagtgcatattttcaattaagacattcttagaggataaaaaggaattttactactatcagtgtcttaaataaagtaatcggttatatacggatgtggagtcgataaatgagattgaaggaatatatatgaaattaagatttatttcgtctgcgctggctgccgcactattcgccgctacgggtagttatgctgccgttgtagatggcggtacaattcactttgaaggcgaactggtgaatgctgcctgttcagtgaatactgactcggcagaccaggttgtcacactcggtcaatatcgtaccgatattttcaatgctgttggtaatacctctgcattaattccattcaccattcagttgaacgactgcgatcctgttgttgccgctaatgctgccgttgcattttctggtcaggctgatgcaatcaatgataatttattggccattgcatccagtaccaatacaacaacagcaacgggtgtcggtattgaaatacttgataatacatccgcaattctcaaacctgatgggaatagcttctcaaccaaccagaacttgatccccgggaccaacgttcttcatttttctgcacgttataaaggcaccggtacaagtgcatcagcagggcaagcaaatgctgacgcgacttttattatgagatacgaataatcaaaaccacgttgttttgaattatatatcacgtcttataacaaagtaatgtaccggttgtctgaagcggtatggtggcaatgtaaatcgaaatcatgttcactttgtatcatgccgctttattaaatgaaaagggaatgatgtgttgtaagaaaccaaagcaatcatttctttatatttcttatttttgccgtcaggaatacacaaggcgtattaactatgatgactaaaataaagttattgatgctcattatattttatttaatcatttcggccagcgcccatgctgccggagggatcgcattaggtgccacgcgtattatttatcccgctgatgctaaacagactgcggtatggattagaaatagccataccaatgagcgctttctggtcaattcgtggattgaaaacagcagcggtgtaaaagaaaagtcattcatcattacaccgccactgtttgttagtgaacccaaaagcgaaaataccttgcgtattatttacaccggtccaccgctggcagcagatcgtgagtctctgttctggatgaatgttaagacgatcccttcggtagataaaaatgcattgaacggcaggaatgttttgcaactggcgattttatcgcgcatgaaattatttctccgtctaattcaattacaagaattacccgcagaagcaccggacacactcaagttttcgcgatccggtaactatatcaatgttcataatccctcacctttttatgtcactctggttaacttacaagtgggcaaccaaaagttggggaatgctatggctgcacccagagttaattcacaaattcccttaccctcaggagtgcagggaaagctgaaatttcagaccgttaatgattatggttcagtaaccccggtcagagaagtgaacttaaactaaccgaatcatctgacaatatcagagctaattatgaaaatacccactactacggatattccgcagaggtatacctggtgtctggccggaatttgttattcatctcttgccattttaccctcctttttaagctatgcggaaagttatttcaacccggcatttttattagagaatggcacatccgttgctgatttatcgcgctttgagagaggtaatcatcaacctgcgggcgtgtatcgggtagatctctggcgtaatgatgagttcattggttcacaggatatcgtatttgaatcgacaacagaaaatacaggtgataaatcaggtgggttaatgccctgttttaaccaggtactccttgaacgaattagccttaatagcagtgcatttcccgagttagcccagcagcaaaacaataaatgcatcaatttactgaaagctgtacctgatgccacaattaactttgattttgcagcgatgcgcctgaacatcactattcctcagatagcgttgttgagtagcgctcacggttacattccgcctgaagagtgggatgaaggtattcctgctttactcctgaattataatttcaccggtaacagaggtaatggtaacgatagctatttttttagtgagctcagcgggattaatattggcccgtggcgtttacgcaacaatggttcctggaactattttcgcggaaatggatatcattcagaacagtggaataatattggcacctgggtacagcgcgccattattccgctgaaaagtgaactggtaatgggagacggcaatacaggaagtgatattttcgatggtgttggatttcgtggtatacggctttactcttccgataatatgtatcctgatagccagcaagggtttgccccaacagtacgtgggattgcccgtacggcggcccagctaacgattcggcaaaatggttttattatctatcaaagctatgtttcccccggcgcttttgaaattacagatttgcacccgacatcttcaaatggcgatctggacgtcaccatcgacgagcgcgatggtaatcagcagaattacacaattccgtattcaacagtgccaattttacaacgcgaagggcgtttcaaatttgacctgacggcgggcgattttcgtagcggtaatagtcagcaatcatcgcctttcttttttcagggtacggcactcggcggtttaccacaggaatttactgcctacggcgggacgcaattatctgccaattacaccgcctttttattagggctggggcgcaacctcgggaactggggcacagtgtcgctggatgtgacccatgcgcgcagtcagttagccgacgacagtcgtcatgagggggattccattcgcttcctctatgcgaaatcgatgaacaccttcggcaccaattttcagttaatgggttaccgctattcgacacaaggtttttatacccttgatgatgttgcgtatcgtcgaatggaggggtacgaatatgattacgattacgacggtgagcatcgcgatgaaccgataatcgtgaattaccacaatttacgctttagccgtaaagaccgtttgcagttaaatatttcacaatcacttaatgactttggctcgctttatatctctggtacccatcaaaaatactggaatacttcggattcagatacctggtatcaggtggggtataccagcagctgggttggcatcagttattcactctcattttcgtggaatgaatctgtagggatccccgataacgaacgtattgtcggacttaatgtttcagtgcctttcaatgttctgaccaaacgtcgctacacccgggaaaatgcgctcgaccgcgcttatgcctcctttaacgccaaccgtaacagcaacgggcaaaatagctggctggcaggtgtaggtgggaccttactggaaggccacaacctgagttatcacgtaagccagggtgatacctcgaataatgggtatacgggcagcgccacggcaaacttgcaggccgcttacggtacgctgggggtcgggtataactacgaccgcgatcaacatgacgttaactggcagctgtctggcggtgtggtcgggcatgaaaatggcataacgctgagccagcctttaggggataccaatgttttgattaaagcgcctggcgcaggcggtgtacgcattgaaaatcaaactggcattttaaccgactggcgcggctatgcggtgatgccgtatgccacggtttatcggtataaccgtatcgcgcttgataccaatacgatggggaattccatcgatgttgaaaaaaatattagcagcgttgtgccgacgcaaggcgcgttggttcgtgccaattttgatacccgcataggcgtgcgggcgctcattaccgttacccagggcagaaaaccggtgccgtttggatcactggtacgggaaaacagtaccggaataaccagtatggtgggtgatgacgggcaagtttatttaagtggtgcgccattgtctggtgaattactggttcagtggggagacggcgcgaactcacgctgcattgcgcactatgtattgccgaagcaaagcttacagcaagccgtcacagttatttcggcagtttgcacacatcctggctcataaaggaaattatcaatgaagataatctgcagattattattggcgatggcatgtttgtggttaacaaacatatcctgggctactgtttgtgcaaatagtactggcgtagcagaagatgaacactatgatctctcaaatgtctttaatagcaccaataaccagccagggcagattgttgttttaccggaaaaatccggctgggtaggtgtgtcagcaatttgtccacccggcacgctggtgaattatacataccgtagttatgtcaccaactttattgttcaggaaactatcgataattataaatatatgcaattatatgattatctattaggtgcgatgagtctggttgatagtgttatggatattcagttccccccgcaaaattatattcggatgggaacagatcctaacgtttcgcaaaaccttccattcggggtgatggattctcgtttaatatttcgtttaaaggttattcgtccctttattaacatagtggagatccccagacaggtgatgtttaccgtgtatgtgacatcaacgccttacgatccgttggttacacctgtttataccattagttttggtggccgggttgaagtaccgcaaaactgcgaattaaatgccgggcagattgttgaatttgattttggtgatatcggcgcatcgttatttagtgcggcagggccgggtaatcgacctgctggtgtcatgccgcaaaccaagagcattgcggtcaaatgtacgaatgttgctgcgcaggcttatttaacaatgcgtctggaagccagtgccgtttctggtcaggcgatggtgtcggacaatcaggatttaggttttattgtcgccgatcagaacgatacgccgattacgcctaacgatctcaatagcgttattcctttccgtctggatgcagctgcggcagccaatgtcacacttcgcgcctggcctatcagtattaccggtcaaaaaccgaccgaggggccgtttagcgcgctggggtatttacgcgtcgattatcaatgaggtacggagaatgagaagagtactctttagctgtttctgcgggttactgtggagttccagtggatgggcagctgaccctttaggaacgattaatatcaatttgcacggtaacgttgttgatttctcctgtaccgtaaacacagcggatattgataagacggtagatttaggcagatggcctacgacacaattactgaacgctggcgataccacggcactcgtcccttttagcctgcggctggagggatgtcctccgggttcagttgcgattttatttacgggaacgccggcatccgataccaacctgctggctctggatgatcccgcaatggcacaaaccgtcgccatcgaattacgtaatagcgatcgctcccggctcgcactgggggaggcgagcccgactgaggaagtagatgcaaatggcaatgtcacactaaacttttttgccaattatcgagcgttagccagcggtgttcggccaggtgtggcgaaagcggatgcgatatttatgatcaattataattaatattatattaattcgtataatttggcgtagtcgataagctctacaattgaatgcaaacctagcttgccataaatattagatttatgcgcactaactgttttattgctaagtaataacttatcggcaatttctttattagataatccgctaaccagataacgtaatatggtcacttcacgattagatagcacagtgatcgttgaactattcgtactacatttattgctttttatatagttaagcgtttcgctaggaaaaaacgtgtatccggagaggatcatctgaacggcatgaaaaatatcattctgatcattgcatttactgacaaaaccgttagcaccagcttgtatcgctctgccagcataaaagcattctgatttcgatgataaaaataacactttcactgtgctctggatttgtttgatccttttcaggaaggtaaaaccgtctgttccgggcaagtctatatccataatgattaaatcaacaggacgggttcggagataatcgatggttatgcggtaatcatccgttttcaggacaatctgcaattcactgtttttttgcaacagaacttcaatagacattctgatgataggatgagtatccataatgatcaccgacgttggtttcatagttaccagtctcataggagcggacaattttccgttagggcggtaaattgtactttgatacatgaaaatacgggttttcttgattcagacgcgcagcggtgtgcgtttgtttgccactatagcgaaataaatcagaaaatcagacgcggtcgttcacttgttcagcaaccagatcaaaagccattgactcagcaagggttgaccgtataattcacgcgattacaccgcattgcggtatcaacgcgcccttagctcagttggatagagcaacgaccttctaagtcgtgggccgcaggttcgaatcctgcagggcgcgccatttcttcttcatttatgcccgtcttatccgtttccgctttgcccttcaccacatcactttttgtcgctgtttggcgagataattcaacggtgtcaggccgtaaaacgccttaaaaacagagataaagtacgacgtgctgctatagccacataattgcgccacctgagtgatatttttgttatccatcaataacatctgtacggcgtaacgcatacgacactctgtgacaatctggctatagctggtattttcgttttttaatttctttttgagcaggctggggcttaaacatagcgaactggcgacaattcgcagattccagtaatgctgaatatcgctttgaataatgcggcagacgctgtcgcggacgctgctgcgtaagatatacatcagtagggcaataaaccgcgattgctcaagaaagttagacaatacggtaaaaagtaatgcgcgcgtcaactccgcttcgcagggtttgctgggttgctgcttgctgtggttggcggctagccggaacacttccggtgtacggctatgacaagcgataaccggggttgccagccgcgactagggctttacacaggttaagttcttatttaaaaacaacagataatcgttgatgatgttacggttgatgtgggtgattaatacgtgatttaacgttgagagttcaatgacgttattgttgcacgcgaaggcggccaggtagtttttcggaagggtaaacgtagcatggttattgacgcttacctctaccgtccgtccaggccagcaggttgctgtggcggtcatagcgaaatccttccgcgccggttccagcacgttcaatgccgctcagtttatggtgctgcttttccccagcaggtttcccagtttgcccagtttcgccagattccccagttttcccagcagtcctgctggcggcagaagatagctggctatcgttattcctcccaggatcattctctgccatggcgggaactccggctggatatccagataggtgacctgctcacccccaataaagacgtccggcgaaccttccacgatcgccgcactgcactccagtttgtcgcccttgcgcgcggcaggctgattgttgataaagacgttgctactgccctgggctatcctcggtggtttgttctccttgtcgcagagcgccgtgtcctcaccggcttccgggaaatccacatcttttttgatttcgccacgcccgcccaccatggtggcaaactccattaataccggaccggcgggaaacagaagcgatgcgccggcgctgacgagatccataaaaccggcattgctttccgtcagggtgataacagcgttcccccaggccttcgccagtggtactgctttttccgctgccgattcaagcaggtcagtggcaatatcaccccatgagggttccccctgtgggatttcaggtattgctccaggtgggggaggagggggaagggtgacggcggcccttgcagcgggctttccgttaatgtttacattttcagaaccggtattgatggcgccgtccgtgtcacaaaagctgtttatccatgattcaagctggttctgtttctcctccacataatcactcgccttatagctggcatacatcagcgcaggcaccagaaccagcgcataagggccggtggcgcaggcggccataatcaggcaaccttctgcgatggtcactatcgcccccagcacggcccctgccagtgcccccagaaaacttttatgctgaatttcatcgcccagcctggcggcaggtgggccggacttctttgctgccagcatctgtgcaatggctttgtcgttggctgcccgtttcatctggctggcgaccatcgcctgctgtgacagcattcgcattgccagcgtaccgcctgcggtcgctccctgtggcccgcctggtccttcactcatgtgttatccctcgtttatgtcagcgcggctggtccttttggatgtcattctccggtggcaacggggttaagctctttatcacctccagcagcatcgtcttttgactgttcttcagggataaggaggtgctgaaagtgaaggtcagcagcgtatctccacgccgctggaatacggctatctggctaatccgcccctgattcccctcatcttccggaccgttccaggaataatccagcagccaggccggggcctctgccagagtgatttcccggcaggcatgttcggtgtacccatcaagtttgccctggtacagcgccagcgtttcctggtacagctctggtgtcagggttccctgtggaacggcttcgcgggtaatgaccaggttgatgccactgttatctgtggacaccaggacctgcattgactgatcctgccattgagacggcagttgaatgtggccttcattaaaagtgaactgcataaaatactccctgataatctgagtgaatcagttgatgaaaacagaaccgcccacgatggtgatgccatccttcgacagcctgattaccgtcgattccccgacctgtagctgaatgccatccggcgtcagcgcaattttgctttcctccacagccagcaaaatttccttaatcgccgtataagcctgtataccgtcgccttcgccaccattgtttacagcgtcaacatgcaccgaaccggcaatcgtgcctctgtcctgaaagacatcctcagataaagaccctttcagtactccggtgatcttgtggcctttttccaccgtaagaaggcggttaccttcctggatcgtgaccgtctggtcattttttacggtttcgcggtgatcgtgttttacggtggtggtacggtcgttgagcacttcggtatccatgttcttctgcgcgtggatgtagacctgttctctccctgtcgcatcatcaaacttcagctcattaaatccgctgcccatgtacgttttggagcggatggtcatctgcgtctttgttcccggcaggctgccgggggtgcggttttcctggtggtaggtgcgccccataatgatcggctggtccggatcgccgttgaggaagtccacaatcacctcctgacccacacgcggtatcgccaggtggccaaaaccggtgcctgcccacgcctgtgccacacggatccagcacgaactgtcttggtctgccgggttataacggtcccagttgaacttcacccgcacgcgaccatgttcgtcgcagaagatttcctcgcctgccggtcctgtcacgacagcgctctgcgggccgtcgaccagcggtttcagcaacggctgtggtcgccatgttctgtctgccgggatcaccgcaaaatggttctccagcgccgtccccgctccctgccgtcctggcaccgcctgtggctgttcgccgtgcagttcacttgccaccacctgccattcccggttcaggttcgcctgcggatgccccgtcagcacaattcgccgtcccggccatatctccggcgagcggctcattccccgcgcggtttctgcgttgtttcgccagccgtccatctgccagcgggcaaagttctgcccgtgggcgctcttgaaacgtccggggtagtcatacacttcatactgcgtgcgctggtagtcctggtgctggccttcctgttcaaaacgtccggcccagccggggcgtttaaaggtgtagtctttggtcaccacggaagaagggcggatttgtgcgctgtagcggaactggctgatgcagagggtgctcacctcggtacgggtgttcgggttccatgggatttcaaaagattcgggcagatggcggactgtgtcgcacagcaccaggctctggtcggtacttttgtaagcatgctcctcataaaagaagatgccttcctccgccgccatccggcacagaaaatcgtaatcagtctcaccgtactggacacaaaactcacgggaaggatgcggctcgctgaacagcggactccattcggtcaccccgttttcctgcaacatcgtgccgaggatgcttttgatgtcctcgttctggaagatacggaagttctggcgcagaccggcacgccacagcggcgggtgcaccttcatgctgtacagcatctggtttttgtcgttctccccgagttcaaaccaggtcaccacgcctttcacccggcgctgtacttcatcgccctgccatatcgtcaggtaggccattttgtccagcacctgcgcaaattcaagggagagaaactgctggctgaccagggagagatcgagggaaaagagcgaagagagtgactggttcagatgaaaggaaactaccgcaaaagcatccggcggcaggccgtccacttccagtgtgaaacgtaatccggttgacatagcaacctccagtaaaatgaataatgatccgtaccgtacaactgcggataatgtgataagcgggacgacttcagacgttattagggaaggaacagaaaatgctatggttatgtgagaattttgtttaaatattactttacagaaacgggtgtctgttcagtcaaaaaaataatcacaagctcaacctcttgtttcttggcgttattcaggacaggtacgcatatcacaacgagtaacaaaaacgtaaagttaaaccaatattcataatatatttttattcacagcaataaataatccaattaacattattaaaatgaatgattgcataagaaatatatgctaccgctccaccctgataacatgatctgcacattgcacatcttaacgttgttaaatactggctcaatagtggatattttaaattaggaatttatcaaattcacttgataaatagattgagtgaataatataacaattaatgatgattaatcgcgattaaattattcattgctttatatgatagatggcttgtttataacgatgaaaatttagaaagggcattgtgatctacaattggaagaaacacagatttaactaagtttcatatacaaacatctcgtgaaactttgaaaaataaaagccttcgatatttcatatgtttaataagtttttctctaatttgttgatcaacaataccaggaggtgatgcaccacgccctgaatttgaacttaataatcactctctctccggcagcataatcacaaaccttgtcccccgcgcatctgacgttaccgcaaccgtgcctttatgcgcgacaacaatcgatttcactatcgccagcccaataccgctaccttcaccttttcgctggcgggaagggtcaacgcgatagaaacggtcaaacaatcgcggtaagtgctcgggcgcaatgggcgtaccggggttttcgacggaaacttgcacctgatgattgaccgtctggcagcgcactacaatagcctcactgggtggcgtataacgcagggcattagaaagcaggttgcttaacgcccgacgcagcatcagcggatcgcccgcaacctgacatttgtcgccaacaaatcgcaactccacgccgcgatcttccgctaacgcctcgaaaaaatcgaacactttgccgacttcatccgccaggttgagcattttcttttcggggattagctggttgttatcggcctgagcgagaaacagcatatcgctgaccattttcgccattcgcgtcagctcttcgagattagagtagagcacatcttccagctccttctggctgcgagactggctgagggcgatttccgtttgcgtgatgagattggtaatcggcgtgcgaatttcgtgagcgatatccgctgagaaattggactggcgggtaaagacatcctcaatacgctcgatcatatggttgaacgacagtaccagctgttccagctcaatcggcacggtctgcgggtcgaggcgaacgtcgagatctttcgaggtaatattctggatttgacggctgacgctgcggatcggcgcgtgacctttatgtaccgccaacagtacgataaagacgatcaggatgctgattaccgatgcggtcataataagtttattcatcaaatcatttatgtaatgaagatgaaaatcgatcgaaagcgcgatgtagagcgtataaatcggtttgccgtccaccaacgggccaaccggcaagttaatcatccgccagttgctgtgttccatatgcccgtgaccgtggcctggcatcatcatcgtcgggccggaaaggagatacacctcgccaccctgagcgtctttatcgggtatggcgtcacgcgtaaactcgcggatatccggcgcaccgggggagtgatacaccgttttaccctgactatctgccagggaaatcaacacattggaataaccactgacgatatcttccagcgtcattaagcgtcgggcttgcgtttcgtcagggtgatttagtacccgttcaagggtggcgctaatctcttttaaatcattaatatcctgctcggcaaaatgaacttttactgagtggatcatgatccatgcaaaggcgaaaaacgccgcgatggtggccaggctgataaaaaaggtcaggcgggttgccagcgaaaacgggcgctgaaatggcttactgaccatccggcacctcaagcatgtaacccacgccgcgcacggtctgaattagcttcggctcaaagtcgttgtcgattttgccgcgcagccgcttcaccgccacatcaatagcattggtatcgctgtcaaaattcatgtcccatacctgcgaggcgataagcgagcggggcagcacttcgccctgatggcgaaggaagaactccagcagagtaaactctttactggtcaaagtgatgcgcgtgccgctgcgggtgactttgcggctgacgagatcgaccatcaaatcggcaacctgaaactgactttcgataatcaccgccgccccgcgccgcagtaatgtgcgcacccgcgccagcagttcagcaaaagcgaatggcttcaccaggtagtcatctgcccccaactccagccccttgacgcgatgttcaatggtgccaagcgcggtaagcaacagaatcggcatccctttattggcggagcgtaacatgcgcacgatatcccagccgttcacgtccggcagcataatatcgaggattatcagatcataatcaccggtcatcgccagatggtagccattcagcccgttgtcggccaaatcgaccacaaaaccggcttcggttaaccctttggtcaagtattctccggttttcttttcatcttcgacaatcaacagtttcatatttcctccgcatgttgcccgggcaattctagagtagcgggatcagatggcaatcgcttattggcaaaatgacaattttgtcattttcctgtcaccggaaaatcagagcctggcgagtaaagttggcggtataaaatcaccagaaattatgagcctatgtctccttgtaaacttctgccattttgtgtggcccttgcgctaaccggttgttcactggcaccggattatcagcgtccggcaatgcccgtgccgcagcagttctcactcagccagaacggcctggttaacgcagcagataactatcagaacgcgggctggcgcaccttttttgttgataatcaggtgaagacgctgattagcgaggcgctggtgaataatcgggatttgcgcatggcgacgctgaaagtgcaggaggcacgggcgcaatatcgtctgaccgatgccgaccgctacccacagctcaatggcgagggcagcggcagctggagcggtaatcttaaagggaataccgccacgacacgggagttttcgaccggccttaacgccagctttgatctcgattttttcggtcgcttaaagaacatgagcgaagccgagcgccaaaattatttagccactgaggaagcccagcgcgcggtgcatattttgctggtttctaatgtcgcgcaaagttatttcaatcagcagctagcgtatgcgcaattgcaaatagccgaagaaacgctgcgtaattatcagcagtcatatgcgtttgtcgaaaaacaactgttgacaggtagcagtaatgttctggcgctggaacaggctcgcggggtgattgaaagtacccgcagcgacatcgctaaacgtcagggggaactggcgcaggcgaataatgcattgcaactgttattgggaagctacggcaagctgccgcaagcgcagacagtaaacagcgacagcctgcaaagcgttaaattaccggcgggattgtcgtcgcaaatcttattgcagcgcccggatattatggaagctgaacacgcgttaatggcggctaatgccaatattggcgctgcacgcgcggcatttttcccgtctatcagcctgaccagcggaatatcaaccgccagcagcgatctgtcgtcattatttaacgccagcagcgggatgtggaattttattcctaaaattgatatccccatttttaatgccggacgcaaccaggccaatctggatatcgccgaaattcgccagcagcagtcggtggtgaattatgaacagaaaatccagaacgcctttaaagaagtggcagatgcgctggcattacgtcaaagcctgaacgatcaaattagcgcccagcagcgttatctggcatcgctgcaaattactttgcaacgggcgcgggcattatatcagcacggcgcagtaagttatctggaagtgctggatgccgagcgttctttatttgcaacccgacaaactttactcgacctgaattatgcccgtcaggttaacgaaatttctttgtataccgcacttggtggcggttgacagcaatatactcgtcatacttcaagttgcatgtgctgcgtctgcgttcgctcaccccagtcacttacttatgtaagctcctggggattcactcgcttgtcgccttcctgcaactcgaattatttagagtatgacttttaactccaggagagaataaatgaaaaaagcactgcaagtcgcaatgttcagtctgtttaccgttattggctttaatgcccaggctaacgaacatcatcatgaaaccatgagcgaagcacaaccacaggttattagcgccactggcgtggtaaagggtattgatctggaaagtaaaaaaatcaccatccatcacgatccgattgctgctgtgaactggccggagatgaccatgcgctttaccatcaccccgcagacgaaaatgagtgaaattaaaaccggcgacaaagtggcgtttaattttgtccagcagggcaacctttctttattacaggatattaaagtcagccagtaacccaggtttaatgagatgaaaaaaatcgcgcttattatcggcagcatgatcgcgggcggtattatttctgcggcaggttttacctgggttgcaaaggcggaaccgcctgcagaaaaaacgtcgaccgcagaacgtaaaatcttattctggtacgacccaatgtatcccaatacgcggttcgataaaccaggtaaatcgccgtttatggatatggatctggtgccgaaatatgccgatgaagagagttctgcgtctggtgtgcgcattgacccgactcagacgcagaatctgggggtgaaaacggctaccgtcacgcgcggaccgctgacttttgcccagagtttcccggcgaatgtcagttacaacgagtatcagtatgccattgtgcaggctcgcgctgccgggtttatcgacaaggtgtatccgcttaccgtgggcgataaagtacaaaagggcacaccgcttctcgacctgaccattcctgactgggtggaagcgcagagtgagtatttactgctgcgcgaaaccggcggtacggcgacccagactgaaggcattcttgagcggctgcgactggcgggaatgccggaggcggatattcgccgcctgatcgccacgcaaaaaatccagacacgctttacgctcaaagcgcccattgatggcgtgatcaccgcgtttgatctgcgcgcgggaatgaatatcgccaaagataacgtggtagcgaaaattcagggtatggacccggtgtgggtcactgctgcgatcccggagtctatcgcctggctggtgaaagatgcctcgcagtttaccctcaccgttccggcgcgaccggataaaacactcaccatccgcaaatggacgctgctacctggcgtggatgccgcgacccgcacgctgcagctgcgtctggaagtcgacaacgccgacgaggcgctaaaaccgggcatgaacgcctggttgcaactcaacaccgccagcgaaccgatgctgctcattccgtcacaagcgctgattgataccggcagcgaacagcgggtgattaccgttgatgccgacgggcgctttgtaccgaaacgcgttgctgttttccaggcatcgcaaggcgtcaccgcattacgctctggtctggcggaaggtgaaaaggtggtttccagcggcctgttcctgattgattccgaagccaatatttctggcgcactggagcggatgcgctctgaaagtgctacccatgcgcattgagggaataaccaatgattgaatggattattcgtcgctcggtggcgaaccgttttttggtgctgatgggcgcgttgtttctgagcatctggggcacctggaccatcattaatacgccagtggatgcgctgccggatctctccgatgtgcaggttattattaaaaccagctatcccggtcaggcaccacaaatcgttgaaaatcaggtgacttatccgctaaccaccaccatgttgtcggtgcctggcgcgaagactgtgcgcggtttctcacagtttggcgactcttatgtgtatgtcattttcgaagatggcaccgatccgtactgggcgcgttcgcgggtgctggagtacctcaaccaggtacagggtaagctgcctgcgggagtcagcgccgagctggggccagatgccacgggtgttggctggatctatgaatatgcactggtggatcgcagcggtaagcacgatctggccgatttacgctcattacaggactggtttctcaaatatgagctgaaaaccatccctgacgttgcggaagtggcgtcggtgggcggtgtggtgaaagagtatcaggtggttatcgatccccagcgcctggcgcagtatggcatcagtctcgccgaagtaaaaagcgcgctggatgcttcaaaccaggaagcgggcggttcgtcgatcgaactggcggaagcggaatatatggtgcgcgccagcggctatctgcaaacgctcgacgactttaatcacatcgttttaaaagccagtgaaaatggcgtgcccgtttatctgcgcgatgttgcgaaggtccagattggcccggagatgcgccggggcattgccgaactaaacggcgaaggcgaagtggcgggcggggtggtgatcctgcgatccggcaaaaacgcccgagaagtgatcgccgccgtgaaggacaaactggaaacgctgaaaagtagtctgccggaaggcgtggagatagttacaacatacgatcgcagccagctcattgaccgcgccatcgacaacctcagcggcaagttgctggaagagtttattgtggtggcggtagtctgtgcgctgtttctctggcatgtgcgctcggcgctggtggcgattatttcgttgccgctggggttgtgtattgcttttattgtcatgcacttccagggactgaatgccaatattatgtcgttgggtggcattgcgattgccgtcggggcgatggtcgatgctgctatcgtcatgatcgagaatgcgcataaacggctggaagagtggcagcaccagcatcctgacgccacgctggataataaaacgcgctggcaggtgatcaccgatgcgtctgttgaagtggggccggcgctatttatcagtctgctgattatcacgttgtcgtttatcccgatcttcaccctggaagggcaggaagggcgtctgtttggcccgttggcgttcaccaaaacgtatgcgatggcgggtgcggcgctgctggcgatcgtagtgatcccgatcctgatgggctactggatccgtggcaaaattccgccggaaagcagtaacccgctcaatcgctttttgattcgtgtttatcatccgctgttgctgaaagtactgcactggccgaaaaccacgctgctggtggcggcgctttcggtgctgacggttctctggccgctcaataaagttggcggggaatttttaccgcagatcaatgaaggcgacttgttgtatatgccatcgacgctgccggggatttccgcagcagaggcggcgagtatgctgcaaaaaaccgacaagctaattatgagcgtacctgaagtggcgcgggtatttggcaaaaccgggaaagcggaaaccgccaccgattctgctccgctggagatggtagaaacgaccatccagcttaagccgcaggagcagtggcggccaggcatgacgatggacaaaatcattgaggaactggataacaccgtgcggctgccggggctggcgaatctgtgggtgccgccaattcgtaaccgtatcgatatgctctcaaccggcattaaaagccccatcggcattaaagtttccggcactgtgctggcggatatcgacgcgatggctgagcaaattgaagaagtagcgcgaacggtgccaggcgtagcttctgcgcttgccgagcggctggaaggtgggcgctatatcaacgttgagattaaccgtgaaaaagccgcacgttacggtatgacggtggcggatgtgcagttgtttgtgacttctgcggtgggcggggcgatggttggcgaaacggtggaagggattgcccgttatccaattaatctgcgttatccgcaaagctggcgcgatagtccgcaggcactgcgccagctgccgatcctgacgccgatgaagcagcaaatcaccctggcagacgtggccgacattaaagtctctaccggaccgtcgatgctgaaaaccgagaatgcgcgcccgacgagctggatttatatcgatgcccgcgatcgtgacatggtgtcggtggttcacgatttgcaaaaagcgatagctgaaaaagtgcagttaaaaccgggcaccagcgtggcattctccgggcagttcgagctactggagcgcgccaaccataagcttaaactcatggtgccgatgacgttgatgattatcttcgtgctgttgtatctggcgttccgtcgggtgggcgaagcgttgctgattatcagcagcgtaccgtttgcgctggtgggcggcatctggttgctgtggtggatgggctttcatctttccgtggcgacgggcactggctttatcgccctcgccggggtcgccgccgaatttggcgtggtgatgctgatgtatttacgtcacgccatagaggccgtgccgtcgttgaataatccacaaacattcagcgagcagaagctggatgaggcgttatatcacggcgcggtcctgcgcgtgcgcccgaaagcgatgacggtggcggtgattatcgccggtctgctgccgattctgtggggaacgggggctggttcagaggtgatgagccggattgccgcgccgatgattggcggcatgatcaccgcacctttgctgtcgctgtttattatcccggcggcgtataagctgatgtggctgcaccgacatcgggtacggaaataaaagcaggataccccgtttaaccgtgtggattgtgtcttgcgacgatgggcactaaatgttaaaaggtgcccctcaacaaaaaagacacacaggggaaaggcgtgaaaaacgcgtcaaccgtatcggaagatactgcgtcgaatcaagagccgacgcttcatcgcggattacataaccgtcatattcaactgattgcgttgggtggcgcaattggtactggtctgtttcttggcattggcccggcgattcagatggcgggtccggctgtattgctgggctacggcgtcgccgggatcatcgctttcctgattatgcgccagcttggcgaaatggtggttgaggagccggtatccggttcatttgcccactttgcctataaatactggggaccgtttgcgggcttcctctctggctggaactactgggtaatgttcgtgctggtgggaatggcagagctgaccgctgcgggcatctatatgcagtactggttcccggatgttccaacgtggatttgggctgccgccttctttattatcatcaacgccgttaacctggtgaacgtgcgcttatatggcgaaaccgagttctggtttgcgctgattaaagtgctggcgatcatcggtatgatcggctttggcctgtggctgctgttttctggtcacggcggcgagaaagccagtatcgacaacctctggcgctacggtggtttcttcgccaccggctggaatgggctgattttgtcgctggcggtaattatgttctccttcggcggtctggagctgattgggattactgccgctgaagcgcgcgatccggaaaaaagcattccaaaagcggtaaatcaggtggtgtatcgcatcctgctgttttacatcggttcactggtggttttactggcgctctatccgtggatggaagtgaaatccaacagtagcccgtttgtgatgattttccataatctcgacagcaacgtggtagcttctgcgctgaacttcgtcattctggtagcatcgctgtcagtgtataacagcggggtttactctaacagccgcatgctgtttggcctttctgtgcagggtaatgcgccgaagtttttgactcgcgtcagccgtcgcggtgtgccgattaactcgctgatgctttccggagcgatcacttcgctggtggtgttaatcaactatctgctgccgcaaaaagcgtttggtctgctgatggcgctggtggtagcaacgctgctgttgaactggattatgatctgtctggcgcatctgcgttttcgtgcagcgatgcgacgtcaggggcgtgaaacacagtttaaggcgctgctttatccgttcggcaactatctttgcatcgccttcctcggcatgattttgctgctgatgtgcacgatggatgatatgcgcttgtcagcgatcctgctgccggtgtggattgtattcctgtttgtggcatttaaaacgctgcgtcggaaataaggcattcacgctacatccgacaaaacgatgtccgctctcatccattcgatgagagcggtttttttaattactgcttaaatgcacccgccagagagcgaatatcattgccggttggcgactgatgaagtcgcagaccaaactcttcgacaatcgcaaatatgtgatcgaatatatcagcctgaatgctttcatattccagccacaccacggtgttggtaaacgcatagatctcgagcggtaaaccattatcacctggagccagttggcgtaccattaaagtcatatctttacgaatccgcggatggttacgcagatattcgttcagataggcacgaaaggttccaatattggtcattcggcgcaggtttaataccgactccgtagaaccttgctggcgattccactcattaatttcctgatggcggctggttaaataaggctttaacaaatgcgctttattcagacgttgcatttcgtcttcatcaagaaaacgaatactggtgacatcaatactgatactgcgcttaatacgtcgcccgccagatgctgacatcccgctccagtttttaaaggagtcagaaaccagagaccaggtgggaatagtggtaatggtattgtcccagttacgcactttgacggtggttaacccaatatcgatcaccgcgccatccgcgccgtatttcggcatctccagccagtcgcccagtttcagcatatcgttcgcggaaagctgaatacctgccaccagaccaagaatcggatctttaaataccaacatcagcacggcagccattgcaccaagaccgctgatcagaatcgctggcgactgaccaatcagcagcgagatcatcaaaatgccgaccagaatcgcgccgatcagtttaatcccctgaaatatccctttcagcggtaactgagatgctgccgggaatttctgcgccagattcaaaataacatccagcaacgagaagactgaaagcagcgcatacatcatgatccacaactgcgcgcaggtagtcagaatatctgccgcttcggtgcctttttgcagccagaataccgcctgaatattgacgataatcccctgcagggtaaaagctaaacggtggaagagtttattctgggtaatgatttgcaaccaaagccgtgaactggcgatggcacgtttttcgaaggtccgcagtaccacccaatgcaaaataatatgcaccacgacggcggtcagaaaaataataccgaaaatcatcaccatcgaggtggtgtgatcgatctcaatacccgctaaatcttcaacctgggatattaaatcctgcataacgtctcctttatacaacagcagcctatgatgacggctgaaacagggttatgcaaatcaggagaatctgaggggaaatagccgggcagatgcccggcaagagagaattacacttcggttaaggtgatgttttgcggcagacgtgatttcggcagcgtagcgttaaaatcttcaacgctgtgatgacctaccggaacaaccaccagactggtgtagcctttctctttcagaccaaattctgcatcgaggatggcggcgtcaaaaccttcgatgggtaccgcgtccagacccagcgccgccacgccgagcaggaagttaccgacgttgagataaacctgttttgccatccactctgcatcatcatgcagatctttacggtgcatatcagcgaagaacttgcgacctttatcgttcgcggctttcgcttccggcgtggcaaagcggccatcagcatcttcctggtcaacaaccagcttcagccaggcatcgtccatcgcggtttttgcacagaacaccacgacgtgcgaggcatcaagtattttacgttcgttgaacacataattaccggcagcggatttggcaacacgcgctttaccttcttccgtgctggcaacaataaaatgccacggctgggagttggtgctggatgggctgtattgcaggagagttttgatctgctcggcctgttccggggtaagttttttactggcatcaaatgccttagtggaatgacgctttaaggcgacagaaatgatatccataaagactccatgtgaaagtaattttgcgtgccagcagattacaaggttcaacgagaaatggtaagcgagaaaaatgcgctatagatttccgctttagcctggacgcactcttttttgatcgcgtttagccagaccatcaaccaccagattccacgaatcgttgatcagatcgcgaagtaacgcttcggagatttcctcgccgggatacaccgaaatccagtgctttttattcatgtgataccctggcttaatgcttgggtatatttgctgatttaacagggatttttgtggatcggacttcagattgataaaggggacgccgcgtagctccgacgacagcataaaaatcttgccgccaattttaaaaacatcgaactccgggccaaaaggccagcaaagctcgacaaagggtaactcaagggccaggcgtttcgccgtttcgtgcagtgattgcttatccataaacgttcctttaggcgaaggagaataagcaaagtatgccgcgaagtacggcgataatcgacgtttaatccgccagcgagaaccagcgtcgccagataaagcgcagaacaaaatactcaatagcgcccagcactaaaaaccacagacaaaacaataaagtgtaaagctgactaagatccatcagatggaacgtgctcaccagtttttgtgccagcgtcagccccaatgcgggggcgggaagcagcaggcaagagaggaaagccatcagcaaaatgcctgctgcggtggtcaaggtttctaaagggtgtttcataacattgttaaatgtaagttaaaacaccattgtcagggatattcttctgtaaggcaattcccgacttagtcaccggcccagatctcacaatgctttttcaccagcccaatcagcgagccgccatcggcgacgaaatcgcgcatcagctgcgcttcattcagaccgctgacgacctggcgatgcagtgcttcaattgcgctcgatgcgccaattttatgtgcggaaggggcgattttttccagcaatcgcaaggtatcttccgttagcggtcgacgatcaccagtgtgcggatcggtaatgacgccttccagcccatagcgacaggcctggaaacggttgaatttatacagcaggtaatctttctcctgatgtttgaacgggcgttccgtcagtaaccagtgggcggtggcctgaattaatcccgccatatttaccgcgtggctaagggttaacggggtatccatcacccgaacctccaccgtgccaaaatgaggactggggcgaatatcccagtgcagatctttaatgctgtcgatcatcgtggtgtaactcaaacagcgaaatagggcttcaaattgttgccagttactgacccacggcatcgggccattatcaggaaaggcggaaaaaatattcggtcgtgaggaggcaaaacgcgtatccgttccctgcatatatggcgacgcggcggaaagggcgataaagtgcggcacaaatcgtgacaagccgtgcagcaaataaatggcgtcatcgccactggcgcagccaacatggacatgctgaccaaaaacggtcgcctgctgaatgagataaccaaagttttccagcgtgcgttgatagcgttcgttatcgcatacctcctgacgctgccatttctgaaacgggtgcgtgccaccgccgcaaatttccagatgatggtctgtgactgcctgcaatacgactttctgcatcgctgaaaactgcccggcagcctggttgatatcacggcaaacatccgtcgccagctccagcatactttcggtgatatcgtgctttacctctccggccgtgatcttatttttaaccgcgtcaatcagcattgaagagtcctggcttaagtcatagcccggcggattaaccacctgcatttccagttcaataccgagggtaaaaggttcagaaacatgaaaatcgggtaatggcataggtttctcttatgttggcgttttctattcagtatagaagtcggagcggctgggcgagatgcggaagttctggaatgtttcttttttttggtgatggtgaactgatggtgcctgaagcaatttggctacttttgcaatgtgacaagttatggcagtgctgactggtggcgaagaattttgacgattgagtcatgcagaaaaaaacgggttcagcttcagttgattaaatgaggagtgagaagtccgaaacaggactcactgtataaataaacagctattttgttgaggaagggtaagataacggcgggtgcctgaagctttccggtttcaggtttactctgaggtctggaaagatgaagccccaggagatatttctatcaaccctggggctgccactccaaacccgaacaatttggatggtagtcccttcttcgcatggaggcaatataaacatgctgacgaaatatgcccttgcggcagtcatagtgctgtgtttaacggtgctgggatttacgcttctggtcggagattcgctgtgtgagttcaccgtaaaggaacgtaatattgagtttaaggctgttctcgcttacgaaccgaagaagtagccgttgtgcggggagcaatcccataagcgctaacttaagggttgtggtattacgcctgatatgatttaacgtgccgatgaattactctcacgataactggtcagcaattctggcccatattggtaagcccgaagaactggatacttcggcacgtaatgccggggctctaacccgccgccgcgaaattcgtgatgctgcaactctgctacgtctggggctggcttacggccccggggggatgtcattacgtgaagtcactgcatgggctcagctccatgacgttgcaacattatctgacgtggctctcctgaagcggctgcggaatgccgccgactggtttggcatacttgccgcacaaacacttgctgtacgcgccgcagttacgggttgtacaagcggaaagagattgcgtcttgtcgatggaacagcaatcagtgcgcccgggggcggcagcgctgaatggcgactacatatgggatatgatcctcatacctgtcagttcactgattttgagctaaccgacagcagagacgctgaacggctggaccgatttgcgcaaacggcagacgagatacgcattgctgaccggggattcggttcgcgtcccgaatgtatccgctcacttgcttttggagaagctgattatatcgtccgggttcactggcgaggattgcgctggttaactgcagaaggaatgcgctttgacatgatgggttttctgcgcgggctggattgcggtaagaacggtgaaaccactgtaatgataggcaattcaggtaataaaaaagccggagctccctttccggcacgtctcattgccgtatcacttcctcccgaaaaagcattaatcagtaaaacccgactgctcagcgagaatcgtcgaaaaggacgagtagttcaggcggaaacgctggaagcagcgggccatgtgctattgctaacatcattaccggaagatgaatattcagcagagcaagtggctgattgttaccgtctgcgatggcaaattgaactggcttttaagcggctcaaaagtttgctgcacctggatgctttgcgtgcaaaggaacctgaactcgcgaaagcgtggatatttgctaatctactcgccgcatttttaattgacgacataatccagccatcgctggatttcccccccagaagtgccggatccgaaaagaagaactaactcgttgtggagaataacaaaaatggtcatctggagcttacaggtggccattcgtgggacagtatccctgacagcctacaaaacgcaattgaagaacgcgaggcatcgtcttaacgaggcaccgaggcgtcgcattcttcagatggttcaacccttaagttagcgcttatgggagcaatccccgcatatccggttgtcaggtcaggatggtaaggcacctgctttacactttcgcccgtggtcagtgatggctgcgggcgaatcgtaccagatgttgtcaattaatcgtgttggcacagcgttatgactatcttttcttttatctgccagtgcacagcaaacatctcattctcacgatgaatgatgacctgctgtttattccagctaattatctgatagtccagaaaacctgcatcagtttggatctcacttgccttaaatgcgctctctttggcggaaaatgccagtgtcagcgccagagaaaaggctaaaccgcagtctgcgagtcgctcgtgttctgctggtgtaataatgttgtctgtcaattcggtcgctgtttgcgcagaaaaaatttcttcgatatcaacgccaatcggttgacgggaaaccacggccaatgccgtagccccgcagtggctaatactgccgtatacctccgcaggccacaccggttggcgtagctcgccgattgcgggcacacatttatagccatattcccgcaaagcataaacagcagcgatccgtccggctaaatgctctgttttacgtttacgtccagcgtgttgcagttgtgcgtagtgcggcagccagagtaaatcctgctcacaaaaattcgccggatcgaactcaacaaaatgcagcgtatgtccggcaaaggggagggaggtatgcgtagttttcatatcgaccatattcgagactgatgacaaacgcaaaactgcctgatgcgctacgcttatcaggcctacatggtcctgcaatatattgaattggcaagatttttgtaggccggataaggcgttcacgccgcatccggcatgaacgacgcgcactttgtcaacaatctgacgttagcatcagaagtgagtgtttacgctcatataccacgtacgtcccggctcgttataggtatacgccccggcaccggcgatatagttggcccctgccaaatcgcccgtggtctgggcattacccgcacgccacaaacgtttgtcgaacagattgtccacgccgccggtcagactgacattcttcgtcacatcccaggtcgcgctcaggccaacaatgctgtaaggactaatttctttggtttccggtccaaccgctggctgacctttatagttgtacttcttcggctgctgcttgccgtaccaggtgaaggtcgtttgcatcgacaaatcttcccgtgcctgccagctcagcgttgagttcaacgtatactccgggatgatcgacaaacggtcgcccgtggttttgttttcactcttcagcatataagtgatgttattggtccacatcaccgtttcgctaaccggtacgtttaacgatccttccagaccttcaaccaccgctttcggcacgttatcccactgatagagatcggtgccgactgcgttttgccctacagccacatagcccgcttcaatcttattgcgataatcgttacggaaccaggtgacgcccgccagccagccgtcgcgtttgaactccagaccaatctctttgttgatgctggtttctgctttcaggtcatcgttaccttgcagatagcagccgcccgcgctggcatagcaaccctgacctttactgtagagaatgtagttcgggttagtctggtacaggctcggcgctttataagcacgggcgatgcccattttcagcgtgaagtcatcgcctaaaccttgcgatatgttcagcgccgggctccagttattgccgacaatactgtgatgatcgaaacgcagccccggcgttacgatggtgctgtcagtcagctccatgttgttttcggcaaacagcgagaaaatttctgcttttgaatacgggctacggtcggtggcactcacgccatcaatagcgccaccggtattcgttccggtcagtacctgggtgttggaacttaagtccttcatccgttgctgattccactccgtacccagcgtcagcgtctggttaacgaggaaatcaatcggcaggttaacttcgctatgcagcatcacgtcatcaagatcgatatcgacgaaatcctgtgtcgctttttcgttaaatttcccttcggtaccgcccgccagaccttccggaatacgcgagttacgggtgtgttcgtactgcacccagttgctggtggtcacgccgttatcccagccaccgttccaggtcagcgcgtagttctggcgatacagacggttggtttcatcgccatatttcgagcgggtataggaatcggagttggtattctgggtgtcgcccgcatacaggttaccctggcggctgtaacctgcttccagttccagcgattgcaatggcgcgaaatcccagcgcaccacgccattaatatctttgttgattaccccttcgcgcccggctggtaacgtcgtggcatacgttccggcacgcgcggactgatggccctggttgatatcccacgcgtcagcctgggttttgtcgaggttgccatacaaacggaagctgaattcgtcgcccagcggaccggtcaggctaaagttagtgcgtttggtggcaccttcctctttatgttctggcgcattgaaatatgcgtcccaggagccgtgccactcgccgctgccttttttggtaatgatgttaaccacgccgcccgccgcgccgttgccataacgcgcagctgccggaccacgcagaacttcaatacgttcaatcatttcaggtggcacccaggaagtatcaccacgggtatcgcgctcgccacgccagccctgacgcaccgagttacggctgcttaccggcttgccgtcaatcaaaatcagcgtgttttccggacccataccgcgaatatcaatctgtcggttattcccacgctgaccactggtggagttaccggtcaggttaacgcctggcatggtacggatgatctccgacacatcgcgggcaaccgggtttttgcggatttcatctgcggtgatggtcgaaacgccaggcgcctgtaagttctgctcggcggcggtaacgacaatagtatcgtcatgtgaaacaggagtatcggtcggctcttgtgcctgcgctaccccataaatccccagattgaccaacaaggccagggaatgaatcttcttgttcattgttttattcctgcatttttgccacgaattgcaactgtcgggcatggtcgtcatcaacacgacgcatcccgctaccgcgaaaacctttgatcctgaaagacacgcagtgcagttggttaattaatgtccgcgcttcccacggcgcgccattacgctattgcaaatgcaaatagttatcaataatattatcaatatatttctgcaatcaatgaaaaattgcacagtaaacatggggttatggtgtgacggcgttaaaagtaggaagtgagagctggtggcagtcgaaacatggcccggaatggcagcgtctgaatgacgaaatgtttgaggtcactttctggtggcgtgatccccaaggttctgaagaatactcgacgataaagcgcgtatgggtctacatcactggtgtgaccgatcaccatcagaacagccagccccagtcgatgcagcgaattgcaggcactaacgtctggcagtggaagacacaactcaatgccaactggcgcggcagctactgctttattcccaccgaacgcgatgacattttttctgtaccatcccccgatcgcctcgaattgcgcgaaggctggcgaaaactattaccccaggcgatagccgatccgctgaacctacaaagctggaaaggcgggcgagggcacgctgtttctgcactcgaaatgccgcaagcgcctctgcaaccgggatgggattgtccgcaagcgccagaaatacctgccaaagaaattatctggaaaagtgaacggttgaaaaagtcacggcgtgtatggatttttaccaccggcgatgcaacagcagaagaacgcccgctggcagttttgctcgatggcgaattttgggcgcaaagtatgcccgtctggccagtgctgacttcgctgacccatcgtcagcaacttcctcccgccgtgtatgtgttgatcgacgctatcgacaccacgcaccgcgcccacgaactgccgtgtaatgcggatttctggctcgcagtacagcaagagttattacccctggtgaaagctattgccccttttagcgatcgtgccgatcgcaccgtggttgccgggcagagttttggtgggctttccgcgctgtatgccggactgcactggcctgaacgctttggctgtgtattaagccagtcaggatcgtactggtggccgcatcggggcgggcagcaagagggcgtgttacttgaaaagctaaaagctggtgaagttagcgccgaaggtctgcgcattgtgctggaagcgggtattcgcgagccgatgatcatgcgggccaatcaggcgctgtatgcgcaattacaccccataaaagaatccattttctggcgtcaggttgacggcggacatgatgcgctttgttggcgcggtggcttgatgcaggggctaatcgacctctggcaaccacttttccatgacaggagttgaatatggcattcagtaatcccttcgatgatccgcagggagcgttttacatattgcgcaatgcgcaggggcaattcagtctgtggccgcaacaatgcgtcttaccggcaggctgggacattgtgtgtcagccgcagtcacaggcgtcctgccagcagtggctggaagcccactggcgtactctgacaccgacgaattttacccagttgcaggaggcacaatgagccagcatttacctttggtcgccgcacagcccggcatctggatggcagaaaaactgtcagaattaccctccgcctggagcgtggcgcattacgttgagttaaccggagaggttgattcgccattactggcccgcgcggtggttgccggactagcgcaagcagatacgctgcggatgcgttttacggaagataacggcgaagtctggcagtgggtcgatgatgcgctgacgttcgaactgccagaaattatcgacctgcgaaccaacattgatccgcacggtactgcgcaggcattaatgcaggccgatttgcagcaagatctgcgcgtcgatagcggtaaaccactggtctttcatcagctcattcaggtggcagataaccgctggtactggtatcagcgttatcaccatttgctggtcgatggctttagtttcccggccattacccgccagatcgccaatatttactgcacatggctgcgtggcgaaccaacgcctgcttcgccgtttacgcctttcgctgatgtagtggaagagtaccagcaataccgcgaaagcgaagcctggcagcgtgatgcggcattctgggcggaacagcgtcgtcaactgccaccgcccgcgtcactttctccggcacctttaccggggcgcagcgcctcggcagatattctgcgcctgaaactggaatttaccgacggggaattccgccagctggctatgcaactttcaggtgtgcagcgtaccgatttagcccttgcgctggcggctttgtggctggggcgattgtgcaaccgcatggactacgctgccggatttatctttatgcgtcgactgggctcggcggcgttgacggctaccggacccgtgctcaacgttttgccgttgggtattcatattgcggcgcaagaaacgctgccggaactggcaacccgactggcggctcaactgaaaaaaatgcgtcgtcatcaacgttacgatgccgaacaaattgtccgtgacagcgggcgagcggcaggtgatgaaccgctgtttggtccggtactcaatatcaaggtatttgattaccaactggatattcctggtgttcaggcgcaaacccataccctggcaaccggtccggttaatgaccttgaactggccctgttcccggatgaacacggtgatttgagtattgagatcctcgccaataaacagcgttacgatgagccaacgttaatccagcatgctgaacgcctgaaaatgctgattgcccagttcgccgcggatccggcgctgttgtgcggcgatgtcgatattatgctgccaggtgagtatgcgcagctggcgcagctcaacgccactcaggttgagattccagaaaccacgcttagcgcgctggtggcagaacaagcggcaaaaacaccggatgctccggcgctggcagatgcgcgttacctgttcagctatcgggaaatgcgcgagcaggtggtggcgctggcgaatctgctgcgtgagcgcggcgttaaaccaggggacagcgtggcggtggcactaccgcgctcggtctttttgaccctggcactccatgcgatagttgaagctggagcggcctggctaccgctggataccggctatccggacgatcgcctgaaaatgatgctggaagatgcgcgtccgtcgctgttaattaccaccgacgatcaactgccgcgctttagcgatgttcccaatttaacaagcctttgctataacgccccgcttacaccgcagggcagtgcgccgctgcaactttcacaaccgcatcacacggcttatatcatctttacctctggctccaccggcaggccgaaaggggtaatggtcgggcagacggctatcgtcaaccgcctgctttggatgcaaaatcattatccgcttacaggcgaagatgtcgttgcccaaaaaacgccgtgcagttttgatgtctcggtgtgggagtttttctggccgtttatcgcaggggcaaaactggtgatggctgaaccggaagcgcaccgcgacccgctcgctatgcagcaattctttgccgaatatggcgtaacgaccacgcactttgtgccgtcgatgctggcggcatttgttgcctcgctgacgccgcaaaccgctcgccagagttgcgcgacgttgaaacaggttttctgtagtggtgaggccttaccggctgatttatgccgcgaatggcaacagttaactggcgcgccgttgcataatctatatggcccgacggaagcggcggtagatgtcagctggtatccggcttttggcgaggaactggcacaggtgcgcggcagcagtgtgccgattggttatccggtatggaatacgggtctgcgtattcttgatgcgatgatgcatccggtgccgccgggtgtggcgggtgatctctatctcactggcattcaactggcgcagggctatctcggacgccccgatctgaccgccagccgctttattgccgatccttttgccccaggtgaacggatgtaccgtaccggagacgttgcccgctggctggataacggcgcggtggagtacctcgggcgcagtgatgatcagctaaaaattcgcgggcagcgtatcgaactgggcgaaatcgatcgcgtgatgcaggcgctgccggatgtcgaacaagccgttacccacgcctgtgtgattaaccaggcggctgccaccggtggtgatgcgcgtcaattggtgggctatctggtgtcgcaatcgggcctgccgttggataccagcgcattgcaggcgcagcttcgtgaaacattgccaccacatatggtaccggtggttctgctgcaacttccacagttaccacttagcgccaacggcaagctggatcgcaaagccttaccgttgcctgaactgaaggcacaagcgccagggcgtgcgccgaaagcgggcagtgaaacgattatcgccgcggcattctcgtcgttgctggggtgtgacgtgcaggatgccgatgctgatttcttcgcgcttggcggtcattcgctactggcaatgaaactggcagcgcagttaagtcggcaggttgcccgccaggtgacgccggggcaagtgatgatcgcgtcaactgtcgccaaactggcaacgattattgatgctgaagaagacagcacccggcgtatgggattcgaaaccattctgccgttgcgtgaaggtaatggcccgacgctgttttgtttccatcctgcgtccggttttgcctggcagttcagcgtgctctcgcgttatctcgatccacaatggtcgattatcggcattcagtcaccgcgccccaatggccccatgcagacggcggcaaacctggatgaagtctgcgaagcgcatctggcaacgttacttgaacaacaaccgcatggcccttattacctgctggggtattcccttggcggtacgctggcgcagggtattgcggcgcgactgcgtgcccgtggcgaacaggtggcatttcttggcttgctggatacctggccgccagaaacgcaaaactggcaggaaaaagaagctaatggtctggacccggaagtgctggcggagattaaccgcgaacgcgaggccttcctggcagcacagcagggaagtacttcaacggagttgtttaccaccattgaaggcaactacgctgatgctgtgcgcctgctgacgactgctcatagcgtaccgtttgacggtaaagcgacgctgtttgttgctgaacgcacacttcaggaaggtatgagtcccgaacgcgcctggtcgccgtggatagcggagctggatatctatcgtcaggattgtgcgcatgtggatattatctctccagggacgtttgaaaaaattgggccgattattcgcgcaacgctaaacaggtaaattaatattatttataaacccataattacagaaaataattatgggttttttatttgtttgatttataggtttgatgaatatttctcttaaatagagtgaatgttgcattcagtggaaggaatttacaaacttcagcttcggataattatcaccaactggtaaagtgagcgccgtggagatttccccctattggactcattttcaggttataccccatgtcatcactgaatattaaacagggaagtgacgctcattttcccgattatcctctggcgtcgcccagtaataatgaaattgatttacttaatctaatctcagttttatggcgggccaaaaaaacggtcatggcggtcgtttttgcgtttgcctgcgcaggcttgctgatctctttcatcctgccgcaaaaatggaccagcgcggcggttgtcacgcctccagaacctgttcagtggcaagagttggagaaatcattcactaagcttcgtgtgctggatctggatatcaaaattgatcgtacagaagcatttaacctgtttatcaagaagtttcagtcggttagcttgctggaagagtacctgcgttcatcaccttatgtgatggaccaattaaaagaggcgaaaatcgacgaactggatttgcatcgcgcaattgtcgcattgagcgaaaaaatgaaagcggttgatgacaatgccagtaagaaaaaagatgaaccgtcactgtatacctcctggacgctaagttttaccgcgccaaccagtgaagaggcgcagaccgttttgagcgggtatatcgattatatctctacgttggtggtgaaagagtcgctagaaaacgtccgtaataaactggagatcaaaacccagtttgaaaaagaaaaactggctcaggatcgcattaaaacgaaaaatcaacttgatgcaaacattcagcgcctcaattattcactcgacattgccaacgcggcaggaattaaaaagcccgtttacagtaatggtcaggccgttaaagatgaccccgatttttctatttctctcggtgcagacggtattgaacgcaaactggaaatagaaaaagcggtcactgacgttgcggaactgaacggtgaattacgtaatcggcagtatcttgtcgagcaattaacaaaagcacatgtcaacgatgtgaattttacgccgtttaaatatcagttaagcccgtcattgccagtgaaaaaagacggtccgggtaaggcgattattgtgatcctttccgcgttgatcggcgggatggtggcttgtggtggcgtgctgttgcgctatgcgatggcatccagaaaacaggatgccatgatggcagaccacttagtttaactatttgcggttgaaggtgccgttcgtccgagcggcaccacaagcggcgttccggcaactggatcgtcaatgatcatgcagcgcagaccataaatgcgctcaatcagttcagcagtgacaatctccttcggcgctccctgagcaacaattttcccttcccgcaatgcaatcaaatggctggcgtaacgacaggcctgattaagatcgtgcagcaccgccgccagggtatagcctttttcgcggttcagttcgcttaacaactccagcaaatcaatctgatgactgatatccagccaggtcgtgggttcgtcgagcagcataattgccgtttcctgggccagcaccatcgcgatccacgctcgctggcgttgtccgccagaaagggtatccacgctttgatctgccagatgagttattcccgtggcctgcattgctttcgttaccgcttcttcatcctctttgcgccagcgggtaaacagcggttgatgcggataacgtccacgcgccaccagctcctgcacggtgatatcgcccggcgtggtagcattttgcgccaacagaccaatccggcgtgcaacctctttactggcgtaatgttgaatgtgctcgccatccagccagacatgcccatgagcaggcgtcatcaggcggcttaaggtacgcagtaacgtggatttaccgcagccatttggcccgataattgccgtgaagtgaccatcaggtatttctacagtcagattttccgcaacggtatatttgccatatcccagggttaactgttcgccgcgcaaacgggctactgattcggtcattttttgcgagactcctgaattaacaagacgataaggtaaataccgccgaggctgacggtaacgacgccaaccggaagttgatacggcataaacagttgttgggcgcagagatcggccgccagcagtaacagcgccccgcatagcgccgcctgggttagcccccagcgagcggtgccgctaatgcgtcgggcaatgtgcggtgcgactaaagcaataaaggaaatcggcccggcaagcgctgttgccgcagcggtaagcaccactgcaaccagcatcattaacagacgcgaacgttcgacgctgacgcccagcgcacacgcggtatcatcgcccatttccagcaagcgcatccggcgtaccagtaaggcggcggcaatgagcatcaatataatgatgggtgcggaaggcgaggtttttgcccacgtcaggccgttgagcgatccggcattccacaaacctgctgttagcgccgtttctaaagacgctttcagcaacagccaggtattaaaggccaccagcatggcgcgaacgccgataccgataataatcaaccgaaaggtgtcgatgccgttgcgccaggcgagcagccagaccagcagcgaagtgacaatgccgcccaccattgctgacagcgcgatagccgtcaggtcctgaccaaacagcaccatcgccaccagcacgccgctccacgccccggtgttaaagcccattacgtcagggctgccgagcgggttacgcatcagcgactgaaaaatcgcgccactgacgcccagtgctgcgccaatcaacagcgccatcagcacgcgtggtaaacgccattcggtgaccaccatcgtcatactgcgcggcgcatcgcccatcagcgcggcgaatacctgcgaggtttccagcgtgacggcaccgctgcgtaatccccagatacctgcaaccacacaggcggaaaccagcagcaaacaggtgatgagtaatcggcgagagacgtaaatcatgcaccacctcgcgttttacgtcgcacgaggaagatcagcaccggtgcaccaataaacgcactgaccacagaaacgcgcagttcgccgggcacaatcacccgcccgatgatatcggcaaacagcagcagggcaggggtagcaagtagcgtgacgggcagcgaccagcgatgatcggcacccaccagccaacgcgccatatgcggcatcatcaggccaataaaggcaatcgggccaactactgccgtcgcactaccacaaagcacggtaatcgccagcagaccaatcaactgtgtgcgcgccacgcgactgcccagcgccgtcgcggtgtcgctgccgaggctcaaactgttcagcgcgcgactcagtaatagcgcagttgctccggcgatcagcaccgggatcagcaccacttttaaggtatgtagattgcgaatatccagcgaaccggcttgccagaaacgcaactgatcgtagacgtcaggattaagcagggcgatgccgctggtcagtccttccagcaccgccgccagcgccacgcccgccagggttaaacgcaccggacttaactgcccgccgccctgactgccggtaaaggcaacaatcaatgaggccaccagcgccccggcgaaggccatcgccagttgttcctgcgcggaagagtaaccaaacagcgccgcacccagcacaatggcaaagctggctccggcgttcacgccaagcaagccggggtcggcaagtgggtttcgggtgagggtttgcattaacgccccggcaaggccaagcgcgccgcctgccagtaaaccggcaagggtacgcggcagccgcgcgtcgagcacgatggtgcagtcggcgctctggcaggtgccggagaaggcctccagcactacggaagcggggagtgattttgccccaatgagcaggcttaatgccgtcgcgataatcagtaataacagcaatccgggcacggcaatggcgcgtgtcacggcaacagaaccagacatacgaacttccatgataatgaaattaattatcgttatcgatcttatttggatatgttagcatgtgcagcctaagaataggtatttaaaatatttgatggcaaggcattgtaatgaataaacaatcctggctgcttaacctcagcctgttgaaaacgcacccggcgtttcgcgcagtattcctcgctcgtttcatctcaattgtgtctctgggtttgctcggcgtcgcggtgccggtgcagatccagatgatgacacattccacctggcaggtggggctttcggtgacgctgaccggcggcgcgatgtttgttggcctgatggtcggcggtgtgctggcggatcgctatgagcgcaaaaaagtgattttgctggcgcgcggcacctgtggcattggcttcattggactgtgccttaatgcactgctgccggagccgtcattgctggcaatctatttacttggtttatgggatggttttttcgcatcgcttggcgttacggcgctattggcggcgacaccagcactggtagggcgtgaaaacttaatgcaggccggggcgatcaccatgttgaccgtgcgtctggggtcggtgatttcgcccatgattggcggtttattgctggcgaccggtggcgtagcctggaactacgggctggcggcggcgggcacgtttattaccttgctaccgttgttaagccttccggcgttgccaccgccaccgcagccgcgtgagcatccgttgaaatcattactggcaggatttcgttttctgcttgccagcccgctggtgggcgggattgcgctgctgggtggtttattgacgatggcgagcgcggtgcgggtactgtatccggcgctggctgacaactggcagatgtcagcggcacagattggttttctctacgcggcgatcccgctcggcgcggctattggtgcgttaaccagcgggaagctggcacatagtgcgcgaccagggttattgatgctgctctccacgctgggatcgttcctcgccattggtctgtttggcctgatgccgatgtggattttaggcgtggtttgtctggcgctgttcggctggttgagtgcggtcagctcgttgctgcaatacacaatgctgcaaacgcaaaccccggaagcgatgttagggcggattaacggtttgtggacggcgcagaacgtgacgggcgatgccataggcgcggcgctgctgggtggtttgggcgcgatgatgacaccggttgcttccgcaagcgcgagcggttttggtttgttgattatcggcgtgttgttattgctggtgctggtggagttgcgacattttcgccagacgccgccgcaggtgacagcgtccgacagttaatgcttaaaacagcgccttaagcctatccagcacttgcatggcgctgtagtaatccagacggaacgtctcggttcccagcgcataaacctgcttgttttgtactgcaggcaggtgcgcgagcagcggattagcataaatagcatcggcatctttctgatcaccggcgaacaggaatagtgactcgccatttaaccctgcagccagattttccccaccaagctgaatgatgtcatggcgtttaccctgactttggctggcatttaaccctgcgggtaacttcgccagcgtaaagccgagttgttccagcatctgcccttgtgctgattctggcgtccagagattggcactgtgtgcagcggcagtatagacaatggcagtgaccggctgcggcggtaatttgatttgctctttcgccgccgccagttgcttatcaaactgcgcaatccgctctgccgcttgtttctcatgcccggtaatttcgccaagctgcgttaacagcgactgccagcttttgtcgtcgtaattgatgattaatgtcggggcgatggtggaaagctgatcatacagcgccagcgccgaatccccgccagttgcgctaattaaaatcagatccggcatttgcgcggcaacggcttcggcgctcggttcgccgatatagagccgttgcagtttgcgttctttcgccaccttgctccactggcgtaaaaagccctggtcatccgcgacgcggttatttggcgtggtcgcgccgctggcgatcactggtgcatcaatcgccagcagtgagccggtcagggtgacgctggtggaaacaatacgctgcggctggctttccagtgtatgtgtgccacggctgtcagtaatctgacgcggccagtcagcggcctgaactgcggctattcctgaaagcaaaagtcctgttaatagaagggcgttgcggtagagcggggcgagtctcacaaatcagcttcctgttattaataaggttaagggcgtaatgacaaattcgacaaagcgcacaatccgtcccctcgcccctttggggagagggttagggtgaggggaacagccagcactggtgcgaacattaaccctcaccccagccctcaccctggaagggagagggggcagaacggcgcaggacatcacattgcgcttatgcgaatccatcaataatgcttctcattttcattgtaaccacaaccagatgcaaccccgagttgcagattgcgttacctcaagagttgacatagtgcgcgtttgcttttaggttagcgaccgaaaatataaatgataatcattattaaagcctttatcattttgtggaggatgatatggatacgtcactggctgaggaagtacagcagaccatggcaacacttgcgcccaatcgctttttctttatgtcgccgtaccgcagttttacgacgtcaggatgtttcgcccgcttcgatgaaccggctgtgaacggggattcgcccgacagtcccttccagcaaaaactcgccgcgctgtttgccgatgccaaagcgcagggcatcaaaaatccggtgatggtcggggcgattcccttcgatccacgtcagccttcgtcgctgtatattcctgaatcctggcagtcgttctcccgtcaggaaaaacaagcttccgcacgccgtttcacccgcagccagtcgctgaatgtggtggaacgccaggcaattccggagcaaaccacgtttgaacagatggttgcccgcgccgccgcacttaccgccacgccgcaggtcgacaaagtggtgttgtcacggttgattgatatcaccactgacgccgccattgatagtggcgtattgctggaacggttgattgcgcaaaacccggttagttacaacttccatgttccgctggctgatggtggcgtcctgctgggggccagcccggaactgctgctacgtaaagacggcgagcgttttagctccattccgttagccggttccgcgcgtcgtcagccggatgaagtgctcgatcgcgaagcaggtaatcgtctgctggcgtcagaaaaagatcgccatgaacatgaactggtgactcaggcgatgaaagaggtactgcgcgaacgcagtagtgagttacacgttccttcttctccacagctgatcaccacgccgacgctgtggcatctcgcaactccctttgaaggtaaagcgaattcgcaagaaaacgcactgactctggcctgtctgctgcatccgacccccgcgctgagcggtttcccgcatcaggccgcgacccaggttattgctgaactggaaccgttcgaccgcgaactgtttggcggcattgtgggttggtgtgacagcgaaggtaacggcgaatgggtggtgaccatccgctgcgcgaagctgcgggaaaatcaggtgcgtctgtttgccggagcggggattgtgcctgcgtcgtcaccgttgggtgagtggcgcgaaacaggcgtcaaactttctaccatgttgaacgtttttggattgcattaaggagcgaggatgagcattccattcacccgctggccggaagagtttgcccgtcgctatcgggaaaaaggctactggcaggatttgccgctgaccgacattctgacgcgacatgctgcgagtgacagcatcgcggttatcgacggcgagcgacagttgagttatcgggagctgaatcaggcggcggataacctcgcgtgtagtttacgccgtcagggcattaaacctggtgaaaccgcgctggtacaactgggtaacgtcgctgaattgtatattacctttttcgcgctgctgaaactgggcgttgcgccggtgctggcgttgttcagccatcagcgtagtgaactgaacgcctatgccagccagattgaacccgcattgctgattgccgatcgccaacatgcgctgtttagcggggatgatttcctcaatactttcgtcacagaacattcctccattcgcgtggtgcaactgctcaacgacagcggtgagcataacttgcaggatgcgattaaccatccggctgaggattttactgccacgccatcacctgctgatgaagtggcctatttccagctttccggtggcaccaccggcacaccgaaactgatcccgcgcactcataacgactactactacagcgtgcgtcgtagcgtcgagatttgtcagttcacacaacagacacgctacctgtgcgcgatcccggcggctcataactacgccatgagttcgccaggatcgctgggcgtctttcttgccggaggaacggttgttctggcggccgatcccagcgccacgctctgtttcccattgattgaaaaacatcaggttaacgttaccgcgctggtgccacccgcagtcagcctgtggttgcaggcgctgatcgaaggcgaaagccgggcgcagcttgcctcgctgaaactgttacaggtcggcggcgcacgtctttctgccacccttgcggcgcgtattcccgctgagattggctgtcagttgcagcaggtgtttggcatggcggaagggctggtgaactacacccgacttgatgatagcgcggagaaaattatccatacccagggttacccaatgtgtccggatgacgaagtatgggttgccgatgccgaaggaaatccactgccgcaaggggaagtcggacgcctgatgacgcgcgggccgtacaccttccgcggctattacaaaagtccacagcacaatgccagcgcctttgatgccaacggtttttactgttccggcgatctgatctctattgatccagagggttacatcaccgtgcaggggcgcgagaaagatcagattaaccgtggcggcgagaagatcgctgccgaagagatcgaaaacctgctgctgcgccacccggcggtgatctacgccgcactggtgagcatggaagatgagctgatgggcgaaaaaagctgcgcttatctggtggtaaaagagccgctgcgcgcggtgcaggtgcgtcgtttcctgcgtgaacagggtattgccgaatttaaattaccggatcgcgtggagtgtgtggattcacttccgctgacggcggtcgggaaagtcgataaaaaacaattacgtcagtggctggcgtcacgcgcatcagcctgaaggagagaacacgatggctattccaaaattacaggcttacgcactgccggagtctcacgatattccgcagaataaagttgactgggcctttgaaccgcaacgtgccgcgttgttaatccatgatatgcaggactattttgtcagcttctggggcgagaactgcccgatgatggagcaggtgatcgcgaatattgctgcgctgcgcgactactgcaaacagcacaatatcccggtttattacaccgcccagccgaaagagcagagcgatgaagatcgggcgctgttgaatgatatgtgggggccgggcctgacccgctcgccggaacagcaaaaggtggtggatcgcctgacgccagatgccgacgacacggtgctggtgaagtggcgctacagcgcgtttcatcgttctccgctggagcaaatgctgaaagagagtggacgtaaccagctgattattaccggggtatatgcccacattggctgtatgaccaccgcaaccgacgcatttatgcgcgatattaaaccgtttatggtggcggatgcgctggccgatttcagccgtgacgagcatttgatgtcgctgaaatatgtggccggacgttctggccgggtggtgatgactgaagaattactgccagcacctatccccgccagcaaagcggcgctgcgtgaggtgatcctgccgttgctggacgagtccgatgaaccgttcgatgacgacaacctgatcgactacggtctggattcggtgcgcatgatggcgctggcggcgcgctggcgcaaagtgcatggtgatatcgactttgtcatgctggcgaaaaacccgaccatcgacgcctggtggaagctactctcccgcgaggtgaaataatggatttcagcggtaaaaatgtctgggtaaccggcgcaggtaaaggtatcggctacgccacggcgctggcgtttgttgaggcgggagcgaaagttacaggttttgatcaagcgttcactcaggagcaatatccctttgcgaccgaagtgatggatgttgccgacgctgcgcaggtcgcgcaagtgtgtcagcgactgttagctgaaacggagcgactggacgcgctggtcaatgcggcgggaattttacgcatgggcgcgaccgatcagctcagtaaagaggactggcagcagacttttgcggttaacgtcggcggtgcgtttaacctgttccagcaaaccatgaaccagtttcgccgtcagcggggcggggcgattgtcactgtggcgtccgacgccgcgcacacgccgcgtattggcatgagtgcttatggcgcatcgaaagcggcgctgaaaagcctggcgttgagcgtcgggctggaactggcgggtagcggcgtgcgctgtaatgtggtttcgcctggctccaccgacaccgatatgcaacgcacgctgtgggtgagcgatgacgccgaagaacagcgtattcgcggctttggcgagcagtttaaactcggcattccgctggggaaaatcgcccgtccacaagagatcgccaacacgattttgttcctcgcctctgacctcgccagccatattaccctacaggatattgtggtcgatggcggctcaacgctgggggcataagcatgatctggaaacgccatttaacgctcgacgaactgaacgccaccagcgataacacaatggtggcgcatctgggaattgtgtatacccgtctgggcgatgatgtgctggaagccgaaatgccggttgatacccgtactcatcagccgttcggtttactacatggcggcgcgtcggcggcgctggcggaaacgctgggatcgatggccggatttatgatgacccgcgacggacagtgtgtggtaggcacagaacttaatgcaacacaccatcgcccggtgtctgagggaaaggtacgcggcgtctgccagccgctgcatcttggtcggcaaaatcagagctgggaaatcgtcgttttcgatgaacaggggcggcgttgctgcacttgtcggctgggtacggcagttttgggatgaacccgacagaattagatgagattgcaggaaaactcggttaacggagtgatcgagttaacattgttaagttaaatattggtttcaactccgatttacatggttgctgtgttgttaaattgtacaaagatgttatagaaacaaaatgtaacatctctatggacacgcacacggataacaactatgaacaaatcagggaaatacctcgtctggacagtgctctctgtaatgggagcatttgctctgggatacattgctttaaatcgtggggaacagatcaacgcgctgtggattgtggtggcgtcggtctgtatctatctgatcgcttaccgtttttatgggctgtatatcgccaaaaatgtgctggcggttgacccgacgcgtatgacgccagcggtgcgccataacgacgggctggactatgtgccgacggacaagaaagtgctgttcggtcaccattttgcggccattgccggagcaggtccgctggtggggccggtactggcggcgcaaatgggctacctgccggggatgatctggctgctcgctggggtggttctcgccggtgcggtgcaggatttcatggtactgtttgtttctacgcgccgtgacggtcgctcgctgggtgagctggtcaaagaagagatggggccaaccgccggggtgattgcgctggtggcctgctttatgatcatggtcattatccttgcagtgctggcgatgatcgtggtgaaagccctgactcatagcccgtggggaacatataccgttgcgttcaccattccgctggcgctgtttatggggatctacctgcgctatctgcgtccggggcgtattggcgaagtgtcggtcatcggtctggtattcctgattttcgccattatctctggcggctgggtggcagaaagtccgacctgggcaccgtactttgactttaccggcgtgcagttgacctggatgctggtgggttacggttttgtggcggcggtgctgccggtgtggttactgctggccccgcgtgactacctctctaccttcctgaaaatcgggactatcgtcggtctggcggtaggcattttgattatgcgcccgacgctgaccatgcctgcgctgaccaaatttgtcgatggcactggcccggtatggaccggtaacctgttcccgttcctgtttatcaccatcgcctgtggcgcggtgtctggcttccatgcgctgatctcttctgggaccacgccgaagatgctggcgaacgaagggcaggcgtgctttatcggctacggtgggatgttaatggaatccttcgtggcgattatggcgctggtttccgcctgtatcatcgatccgggcgtgtattttgccatgaacagcccgatggcggtgctggctccggcagggacggcggatgtggtcgcttctgccgcgcaggtggtgagtagctggggctttagcattacaccagatacgctaaaccagattgccagcgaagtgggtgaacagtcgatcatttcccgtgcgggcggtgcgccgacgctggcggtggggatggcctacattctgcacggcgcgctgggcggcatgatggatgtggcgttctggtatcacttcgccattttgtttgaagcactgtttattctgacggcggtggatgcaggtacgcgtgctgcgcgctttatgttgcaggatctgctgggcgtggtgtctcctggcctgaagcggaccgattcactgcctgctaacctgctggcaacagcgctgtgcgtactggcgtggggctacttcctccatcagggcgtggtcgatccgctgggcggcattaacactctgtggccgctgtttggtattgccaaccagatgctggcagggatggcgctgatgctctgtgccgtggtgttgttcaagatgaaacgtcaacgttacgcctgggtggcgctggtaccaacggcctggctgctgatttgtaccctgaccgcaggctggcagaaagcgtttagcccggatgcgaaagtcggcttcctggccattgctaataagttccaggcaatgatcgacagcggcaatattccgtcgcagtatactgagtcacagctggcgcaactggtgttcaacaaccgtctggatgccgggttaaccatcttctttatggtggtcgtggtggttctggcactgttctcgattaagacggcactggcggcattgaaagatccgaagccaacggcgaaagaaacgccgtatgaaccaatgccggaaaatgtcgaggagatcgtggcgcaggcaaaaggcgcacactaaagtcagagtgagggggggatgttggcgaatgttggcttagtgcccagggttccctctcaccctaaccctctccccggtggggcgaggggactgaccgagcgcgttgatagcatttgtaggccggataaggcgttcacgccgcatccggcactctttcagcaacatggttagcggaggccaagatgtttgattcactggcaaaagccggaaaatatttaggtcaggcggcgaagctgatgattggtatgcctgattacgacaactatgtcgaacatatgcgggttaaccatcccgatcaaacgccgatgacctacgaagagtttttccgtgagcggcaggacgcgcgctacggtggaaaaggcggcgcgcgctgctgctaaatttgtacgtcaggctttaaacgattccacttttttgaacgctgcacgcaacgtatctggtgtcagcgtgactggcaggtaatgaatggactccaccggacgcagggtgtgggcaatcactttgtcgatctccgcctgattattgatatccacttccagctccgccagtgtagtcggcagatgaaaacgctgatacgctccagttaattgcgccagcacatcatcctgacccagcaaggcgctttgcaccagaattccgtaggcgactttggtgccgtggagaaacttctcggtttgcggcagcacggtcagaccgttatgcacggcatgagctgccgccacacgcgtaaaacgatcgcccagaccaccaaccatcccaccaccagcaataatagcatccaccacatcgcaaaatgattgcgttaactgttgattttgctgatcgctcagcgcctgttcgctactgtttaacaagacgtcgcgaatggcttgcgcattattgatccccagtcgcacggttagcggcaacgtttctggttgcggagccagcaccaccgcttcataccatttcgccagcgtgtcaccgatccccgccagcagatattgttgcggtgcattgaggataatctccggttccaccagcaccataaaattggcgtcgtcgaaaatctcataatgcagcgcctgtccggcatcattataccagacggagagcggtgtccaggcggcgcaggtggcggcgatcgtcggaacggcaacaaacggcagaccgagacggcgggcgagggctttcgcggtgtcgagcagtgcaccgccaccgacgccaatcaccacgctgcggtcgtcaccggactcagccgccagttgttgtacatcgctttcgctgcaatgaccgcgaaacaaaatatgctttgcccctggcagtccaaacgctggcggaagtttggtttgcgccgcagcaatggcgcgtttgccgtagatccacaccgcgcgagaaagttgttcatcagtgaaaaaatcgtgcaggtgattgaaacttcctggatgtgaaaagtagttagccgggccgacgaccacgcggataggattgtgaggcatgttgtgttgtccttattgttttatttagacatctaaacgtcttgattgccaaatactagcatcgtgttatagtgccttcaacacgcaacttcgtcaggtacaataaaaatgacaaataaccctctgattccacaaagcaaacttccacaacttggcaccactattttcacccagatgagcgcgctggcgcagcaacaccaggcgattaacctgtcgcaaggctttcctgattttgatggtccgcgctatttacaggagcggctggcgcaccacgttgcacagggggcaaaccaatacgcgcccatgaccggcgtgcaggccttgcgcgaggcgattgctcagaaaacggaacgtttgtatggctatcaaccagatgccgatagcgatatcaccgtaacggcaggggcgacggaagcgttatacgcggcgattaccgcactggtgcgcaatggcgatgaagtgatttgttttgatcccagctatgacagttacgcccccgccatcgcgctttctgggggaatagtgaagcgtatggcactgcaaccaccgcattttcgcgttgactggcaggaatttgccgcattattaagcgagcgcaccagactggtgatcctcaacactccgcataaccccagtgcaactgtctggcagcaggctgatttcgccgctttgtggcaggcgatcgccgggcacgagatttttgtcattagcgatgaagtctacgagcacatcaacttttcacaacagggccatgccagtgtgctggcgcatccgcagctgcgtgagcgggcagtggcggtttcttcatttggcaagacctatcatatgaccggctggaaagtgggttattgtgttgcgccagcgcccatcagcgccgaaattcgcaaggtacatcagtatctgaccttttcggtgaataccccggcacagctggcgcttgctgatatgctacgtgcagaacctgagcattatcttgcgttaccggacttttatcgccagaagcgcgatattctggtgaatgctttaaatgaaagccggctggagattttaccgtgtgaaggtacatactttttgctggtggattacagcgcggtttctaccctggatgatgttgagttttgccagtggctgacgcaggagcacggcgtagcggcgattccgctgtcggtgttttgcgccgatcccttcccacataaactgattcgtctctgttttgccaagaaggaatcgacgttgctggcagcagctgaacgcctgcgccagctttagctatttaaccgtccaggcgcgggaatattgacggtcggcaaacaactcttgcaggccgttaatttgcttcaggcgcagcacttcgtcgctgtccattcccagctctttgccaattttattatcgtcccatcccaactggctaagttcacggacgatttccgacatggcggtgatttgatggcgtccacgagcgcgattatgacgaatagtcgcggcgatgcgttgattacgcgtaccttccagacaggtcaccggcaaataaccttttaagcgtaattttaatgatgatgagcctttaccaatttcatggcggtgaaaaccatccacgatttccatggcatttttatccgtatgtgtgaccacaatgggttgggtaaaaccatctatttcaatggatttttgcagcagttttttttcgggtggtgccacgttgtttgggttgtaatcattaggcataagttggctgtttttaacccacagaacgcaatccactggctcttcacgaaaggggctaacctgatggatcgccatgcggatttcattaatcgctttgatgcgatcatcttccggcaagctggcgagaaattgcgttaaatcctgcgttaatcgttgttgcatagtatcccccattcctgacgttttccttttatccgttcgttataacgctgatagttcttcgattttgtggggctaaatgataatgcccgacaccagtaatcgttattgagtaaaactttgcatatccgccgccaggaggggatatctttcgcgccaatgtccccttgctgggtttgtggaacctcgatgccttttttctgataccagtgcaaataaatggcgattttattgcggtaatgctcagctgttttttccggcatgctattgagcagcaataatgcatattcttgccagtctaaatgttctggcttgaggattttccgatgcccatagaaatgattgtcatgtccggcgtaaatgccgccactttttaccccgctgactcgtgcgcacatagcagcccagcgatccggttcgataacgtgatagagccataatccttgtcgttgctccgggccaaaaggttcgcaaattcgcatatgacgcagaggaacgcctgcttgatacattaggttatacagtgggttgcagagactttgatgatttgcataccaggtccagatatcagccactttccagtcgtaaatggggtaaatgtaccagctatgaccgcctggtgcggccgtagtccagggtttatcgtcggcaaaacgttgtttatttaaactggcgatggcgacaaaacggttgtaggactcatccgcacggatgccgatcatcatcgccgccggacgtttttgtgaaaaccattcggcaaactcacgtacaaattgttcgaaggtcatgcctggctggtaaaaggagaaaaagtcagggtcggttatcgcatcttggagaggttgacgtacccattcgacatcaggttcccagcactgccattcgggttggtattgtgaaagggaattttgcgtcgtaagcgggagcgcaacccagtaaaactcttcgatgacatcggtgtacaactcgcgcagggactgaacatagttaatggtgcaagagaattgcgcctcccagtcgataaacaaaacgcagatttttttgcccatttgtcgggcaagttcggctgtcagatgcagcattaaaccagagtctttgccgccagaaaatgagacacaaacgcggggtagggtattgagtgtccaggtaatacgctctcgtgcagcttccagaatattgagcggaagaggaattttataaatagacatctgaagacgctctctgaacgttacagggtgatcagtgagataagtctgttaattataaagtaaacactgtaaagcagagtgttttatttttcattcgcgctgtgaataaatagatgaaagttatagtagctgtctgtagttatatatcaaaaactctcatttagacggtcaataaatcgggagaacaccaaattatttaaagaagatttattataggaaatgtaaagctttattgaaggtaacggatgttctagttttatctcttttaagttaagaaagtcacggtaggaattataaagttcataggggactattcccagtaaatctgtaactgcaatgctattaatgattgtcagcaaagaggaaccacgaaatgagattttgcgattcataaatctctcgtctatttccatttgaatatcatcaacccctgctgatttagatattaattgggtgaactcttctgccataatttgttcataagtgctattgtcagtaattcgtggatgcctattactacaaattagagtattgcgaatcgtatgcaatggcatgcaaatgacggaacggctgatcactggcatttgggtgatcaccagatcggctttgcggtgaaccaacagttcttcagcattctctgctgacatgaggatatcatggcactcaatctcgacagaggaatcttgccgtaggcagcggatcagcatactattattagagcaagaaatgagctgagggccgtagataataaagtttttctttagttcggacttattgactatattaattgtttgttcaaggcctctgagatttttctcaagatggtgatgcagatttaaccctgttgtcgtcggcgcgataccttttcctgagcgaatgaataaagggtcattaaattgcgcacgtaagcgttgtaacgactggctcacggctgatggggtgatatatagtgattcagcagctttgctaatgcttaaatgctggtaaatacactcaaatatgacaagaagatttaagtcgaactttttcaagtcgtagagattggccatacactactccggttatatttttcttccatgatatattcacttaatcaatgttttttgcgtatatatttttattgattatgtttttttgcttaactcaggattaagtttttctaaaatagcacagccacttagggcagagcgagcaattcatgcttttttaggatggttgaaaagcagggatatagttcaaccatccatgaattaccttttatttattccccataatgatattaagcgttttctgatcgggcaaccccacggcctgttgtagcgtattttccttactcatgtaatagatagccggcgtgacatttgcccccagatcgtccatcagtttctcattgtcacttaacactttcatttgctctgtacttacgtttgcaggcacgtttagcttaagcttgccaccagaggcttcatattgttgccaggtttttgcgggatctttggaggcaagaattgccgctgctgtcgccgggctttctggcttgataaccccaaccaacaatgttcttaattgcactttgccagaatctacccacgggcgcgcctgctgccagaactgtttacaatatgggcagaacggatcggcgaagacgtagacaatgaccggcgcatcttttttaccgtcgaggagccagtgggattgttccatccgttgccacatttcgcgtccggctggtgcgtaaatttctttttcgataagtgtgttactcaggttttcacctttctcgttgtacatgtaaccagagatagcgtgcttaccatctggagtcaggtagatggtgacgcccatatcctgatactttccgagataacctttcattcctccgggggcatcgaatgttttgatgattgtaatgccctgtttttcaatcgcttttactggagcaggaagttcctctgcgaaggcgattgcaggaagcagagccagtaaaagtatcttttttaacattaatttgtccttttcagtcagtgcaaaagtcgagtaaaaggcataacctatcactgtcataggtaagagcttagatcaggtgattgccctttgtttatgagggtgttgtaatccatgtcgttgttgcatttgtaagggcaacacctcagcctgcaggcaggcactgaagataccaaagggtagttcagattacacggtcacctggaaagggggccattttactttttatcgccgctggcggtgcaaagttcacaaagttgtcttacgaaggttgtaaggtaaaacttatcgatttgataatggaaacgcattagccgaatcggcaaaaattggttaccttacatctcatcgaaaacacggaggaagtatagatgtccttgattaacaccaaaattaaaccttttaaaaaccaggcattcaaaaacggcgaattcatcgaaatcaccgaaaaagataccgaaggccgctggagcgtcttcttcttctacccggctgactttactttcgtatgcccgaccgaactgggtgacgttgctgaccactacgaagaactgcagaaactgggcgtagacgtatacgcagtatctaccgatactcacttcacccacaaagcatggcacagcagctctgaaaccatcgctaaaatcaaatatgcgatgatcggcgacccgactggcgccctgacccgtaacttcgacaacatgcgtgaagatgaaggtctggctgaccgtgcgaccttcgttgttgacccgcagggtatcatccaggcaatcgaagttaccgctgaaggcattggccgtgacgcgtctgacctgctgcgtaaaatcaaagcagcacagtacgtagcttctcacccaggtgaagtttgcccggctaaatggaaagaaggtgaagcaactctggctccgtctctggacctggttggtaaaatctaaatttccttcgtctttcacgccatagcggcgttggcgtcgcccgctcaccccggtcacttacttgtgtaagctcccggggattcacaggctagccgccttgctctgacgcgaaatacttcggaaattcacctaattcttcgggtgctgcggcacccgattttcttccccgcaccatgatgcaagctgcatccaggtagccgcagaggccgcttgcatgatgatgtttaaagcccaggagataaacatgctcgacacaaatatgaaaactcaactcaaggcttaccttgagaaattgaccaagcctgttgagttaattgccacgctggatgacagcgctaaatcggcagaaatcaaggaactgttggctgaaatcgcagaactgtcagacaaagtcacctttaaagaagataacagcttgccggtgcgtaagccgtctttcctgatcaccaacccaggttccaaccaggggccacgttttgcaggctccccgctgggccacgagttcacctcgctggtactggcgttgctgtggaccggtggtcatccgtcgaaagaagcgcagtctctgctggagcagattcgccatattgacggtgattttgaattcgaaacctattactcgctctcttgccacaactgcccggacgtggtgcaggcgctgaacctgatgagcgtactgaacccgcgcatcaagcacactgcaattgacggcggcaccttccagaacgaaatcaccgatcgcaacgtgatgggcgttccggcagtgttcgtaaacgggaaagagtttggtcagggccgcatgacgttgactgaaatcgttgccaaaattgatactggcgcggaaaaacgtgcggcagaagagctgaacaagcgtgatgcttatgacgtattaatcgtcggttccggcccggcgggtgcagcggcagcaatttactccgcacgtaaaggcatccgtaccggtctgatgggcgaacgttttggtggtcagatcctcgataccgttgatatcgaaaactacatttctgtaccgaagactgaagggcagaagctggcaggcgcactgaaagttcacgttgatgaatacgacgttgatgtgatcgacagccagagcgccagcaaactgatcccagcagcagttgaaggtggtctgcatcagattgaaacagcttctggcgcggtactgaaagcacgcagcattatcgtggcgaccggtgcaaaatggcgcaacatgaacgttccgggcgaagatcagtatcgcaccaaaggcgtgacctactgcccgcactgcgacggcccgctgtttaaaggcaaacgcgtagcggttatcggcggcggtaactccggcgtggaagcggcaatcgacctggcgggtatcgttgagcacgtaactctgctggaatttgcgccagaaatgaaagccgaccaggtgctgcaggacaaactgcgcagcctgaaaaacgtcgacattattctgaatgcgcaaaccacggaagtgaaaggcgacggcagcaaagtcgttggtctggaatatcgagatcgtgtcagcggcgatattcacaacatcgaactggccggtattttcgtccagattggtctgctgccgaacaccaactggctggaaggcgcagtcgaacgtaaccgcatgggtgagattatcattgatgcgaaatgcgaaaccaacgtcaaaggcgtattcgcagcgggtgactgtacgacggttccgtacaagcagatcatcatcgccactggcgaaggtgccaaagcctctctgagtgcttttgactacctgattcgcaccaaaactgcataagaagaagtaagattcacctgcaattgcttagccgccggggtcaaacctagcggcttttttatggcattaaaaagccctgccgggatggctccgggcagggcgggatatttattctggcaattaacgcacaaccagcaccggcagattggcatggcggatcacgctcgaggcgttagaacctaacagatgggtcgaaatcgatgggttgcgagaaccaataactacaacatcagcccccagttcttctgccaactcattgacttcatcccgcacgctaccaaaacggacatgttgtttaatgcgggaaggatcgatggtgaagtggctgaccatcgtttgcagacgttcttctgcttcatgttgcagatgctcttcaaaacgacgcacatcagcggcaaaacggtgcaggctcaggctggctgacccgggtagtacgtgaagtagatgaataactccgtcatcctgggcgaggaattcagcgtggcgaacagctttgtcgctcaattccatttcaaatacatcaactggcataatgattgtcttatacataaccctttctccctgttaatcatgaacaaatcattcgccatgattataatatttatccctgatatttgtctggttctttttccttacgaacggtttctgtgattaatatattctcactgaacaccaggaattctcccaaaacctgcggtaccgcccgttttcccgctgtgatagctacccttaaagactgactcttttttgaactgtctctggaggttgcatgaaagcattgacttatcacggcccacatcacgttcaggtagaaaatgttcccgatccgggcgttgaacaggcagatgatattattctgcgtattacggcaacggcgatctgtggctctgacctccatctttatcgaggcaaaatacctcaggttaaacatggcgatatttttggtcatgaatttatgggggaagtagttgaaaccggaaaggacgtaaaaaatttgcaaaaaggcgaccgagtggtaattccgttcgtcattgcttgtggcgactgttttttctgtcgattgcaacaatatgccgcctgcgaaaataccaatgcgggtaaaggcgctgcgctcaataaaaaacagataccagctccagcggcattgtttggttatagtcacctgtatggcggcgttcctggtgggcaggcggaatatgtccgcgtccctaaagggaatgtggggccgtttaaagtaccgcctttgctttcagatgataaagcgcttttcctttctgatattctgccaacggcatggcaggcagcaaaaaatgcgcagatccaacaaggttcaagcgttgcagtctatggtgctggtcctgtgggattgttgacaatcgcctgtgcacggttgctcggtgcggaacagatttttgttgttgatcatcatccctaccgcttgcatttcgccgccgaccgctacggcgcgatcccgattaattttgatgaagacagcgatccggcacagtcaattattgaacaaacggcaggtcaccggggcgtggatgcagtaatagacgccgtcggttttgaagcgaaaggcagcaccacggaaacggtgctgactaacctgaaactggagggcagcagcggtaaagcgttgcgtcagtgtattgcggcggtcaggcgtggcggcattgttagcgtaccgggcgtctacgctggatttattcacggtttcctgtttggcgacgcctttgataaagggttgtcgtttaaaatgggacagacccacgttcacgcatggctgggagaattattaccgttaattgagaaaggattactgaaaccagaagaaattgttacccactatatgccgtttgaagaggccggccggggatatgagattttcgaaaaacgtgaagaggagtgccgtaaggtgattctggtacccggtgcacaaaacgcagaggcggcgcagaaggcggtttcaggtctggtgaatgcgatgccggggggaacaatatgatcgtcaggagtggttttcgaggtaaaggacagccatgacgataatcgccgccataatcagaaatcctatcaggatgtaaaatgcttctgccatggttattcccacaaacgaaacggaataattttgcagcaaaagtgaacagtgagaaccaggaaaaattgctgattttgcgtaaagaggatgcgagtgcatcctctgggcaaagcgagttatcgcttgtgcagatgggattaaagcaggtagtcgccagcagcttctggctggtattcgagttccagcacttcaaggtgggttgcaacgccgcccggaagttcccagtgaatggaatcgccaacgcgcagccccagcagtgcggcacctaccggagccataacggaaagctgagtattgctatcggtcatttttgccggatacaccagcgtgcgcacacgcacttcgccatcgctaagattgcggaatttaacccggctgttcattgtcaccacgtcgtgtggcatctcttctggcgaacacatttgggcgcgatccaactctgcgtttaacgcgtcggcgattggcaaaccagcataggcgggttgctccagcagaatatcgatgcgttcggcatccaggtcgttaatgatgatagttggtctggacatttttactccatgtcgtcggtactgcgagtgtcgcagataaacatacccaaaagaaaaccctcaccgtcaggcggcgagggtttaactcacatgatgatactgactgttgctcactctttgaagtgatttgcgtcacattcagggaattcctcaatgcagcgcattatgtataattcttaatcgtcatggttatggaagacgaattagcgtgttttgtaaatcagaggattaataacccgctttatcaatcacaaaggttttgccacagttacctgggtgaggttgtggcaagaatgagtttgcagaaagcggagcgttgatggcgtcagctttgatcgagatctgaatttcagtcaaatacgcagggttaccctggcacgttagcttaactgctttcacgttctcttttccccagcttttggcaaaggcggcgtcaaagtcacggcggctcactgttttaccgtaattatccgcaaggaattttccggcttcgctctctttaatttcttgattcaggcgtaccatagtaccgaagtatgcgtccggatcaaaaccaaagcaggcaccgtgtttggcatattcgtagcgttccaggcaggaacgtccgccagctcctggcatgacttcacttagtttagcggccgtttccagtgataatccggtttccggcgatgaacacatccggctggcgcgcgcttctggtagattcgggattgggcgagtagcgcaaccgaagcgcatccagcggcgttcatcaacaccacgggcagcgaccgatttaggcaatcctggccacagaccatgtacggtcagaaaatcagctttgttggtcgtttcggtttgcaggcgacattcatctcgttcgttacgatttcgatcgtgttgactctggcaaaatccggtttgccaggagagggccaggacatagcgatcaaaatcgccatactgttttgcctgcaacgctatggcgttggcagaagagaagggaagcagagaaaccgcgagcaacgcggcgttacgccagaatgctttcataatgggtgtggaactcatacatacactgaatactatctattaaatcataaaaaagcccgctaggtgggcttacctggcgggcgtgatgatttattcagcgtttggcgaacgtattagttccacatggcgagaatcggccagccaaccaacagcaacatagagatgtaaatcaccccgaagattgcgccaagacgccagtaatcttttgatttcacatagccacagccgtaaataatcaccccaggaccggttgcatacggcgtcagacagcccatgataccgatagacagcaccagcaggatacacagttgttccattggtacgcccggaatacctttaccgacggccagaataaccggcagcatggttgcggtgtgcgcagacaggctggcaaacaggtagtgtgcaaagtagaacaccagaaccagtacaatcaccgttgcgtttggtgagaatccttccaggtgcgtactcatggtaccggcgaaccagtcaataaaaccagaacgagtcaggccgttagccatcacaaccagagttgccaggttgaccagcgtgttccatgcgctgttatagcgggtaatgtctttccacggcacaacgtgcagagccagcattagcgaaactgccagcagaccaaccgcagtagcattaatgacttcactgccaaatacccacaaacctaagctgagcaatacaaggccaatcagcgtccactctctgcgtgtcagcgcacccatggtttttagttcatcacccgcccaggttgccacttcttcactgtgtgtgatttccggtttgtacagcacgtaggaaagccacggcgcaatgataagcaagataaccccaaccggcaggaagcagaggaaccactgcaaccagctaatctggataccggcaattttgctgacgaactccagacccagcacgtttggtgccgcaccggtgacaaacatggacgaactcagactggtactaatgaccatcatccacatcaaatagccgccaatacgacgcgcggacggatcgttggggaatgatttaaacagcggcggcaggtttttaatgaccggaaaaaccgtacccccggtacgcgcggtgttggacggtgtaaacggtgccagcagaatgtcgataatgacaatcgcataacccaacgtcagcgtgcgtttgcccatgaatttcaccaggaaaagggcaatgcgacgacctaacccggaaacttcataccctaatgcaaaaataaatgcgccaaataccagccataccgtggtgctggaaaaaccagccagaccccatttcagcgcctgtttttgcgcattaaacgctgggtcagctaattctttggcatcaaagagcaggtaattactgccaataacgcaaatagtaaccgcaataaaactgatcgctgttgccggaattggctcgaggatcatgccgacaatcattgccacaaacacagcgaagtaatgccatgcctgtggtggcataccgtcggggacagggataagaaacatgacacccatcaccaccagtggggccaatagtttccatatattatcttttgctaaagacatacgggttctccgaaaattaatatttccaaatttatcaagtgcttaaataattaaatctgtgctaaaaaccaggtaaggatcagcaggtcggcactgccgcctggactgagatttcgttcgatacactccctgtcgaactgccggagataatcgagatcggcgggggttcgaatgccccctttttgcaataatgtttgcgcctcgcgctgtagccagcgcaggcccccctcgccaccgcgcgatgcaacgttggtatcgccgttgatcgccatcagtaggagcaaggtatcgagcaatgccagttcaggatctaacccctgatccagcagagtgaggtaatgcggcaaggcgtgattgatcaccagtggataacccgcttcggcttcaccgcgtgcgccggtaaggccaagctgttggtacaaccgttgacctgccgtcagttgtgaattattggtacgcagttcgcgatcggtcaggccacggcagaaacttgccgccgtagaacaaacggttgttggcgttaccggttggttgagttgaagcaaacggccaattgccgcacatagcagccctaaagaaaaaatgctgcctttatgcgtgtttacgcccgcagtggcgcggaacatatcaccttcgcaagccataccaattgggcgtaatccgtggagtaccgcttctggtgccatttccgcactacaggcaccaaattcaatgaaacggggtagccagccctgaatcgccagcgcgctgcggtggaaatcttccagcgccatatctttgtgcgcaccgcagttaatgcgatccacgaggcctggtttcggtgacagattgacttcagtcagcatggcgcgccagcccagcagggcgtactcatcgattaatgacgtcgcaagctttgtggttttagttgacgttgcaggcatcgacatcgttcagcagtgcctccatgcggttgagtaaatcggtcagttgatgggtttttccacgcgcgcagacggctgcgctttgctcgcacaacaggcagcggcgaggcggcagtgaatagtcgcggcgggagagaatttcgccttcgggcgtcaggacatcgatatcccataaccgcccgagaggatgactatgttcaagctcaatggtggcgagcttgaggtcgcgagccggggcggcaatgctcaacatgccctccggcccgctggcggaaaccagtgcagcctgctcctgaatttgccagccctgttttgcggctaaggcacgcaaggctgtcacgccatgattaaaaattcggcgtgtgacctcgcagtctttaatcggcccaggcgcaaccacggtaaaggagaccagtggaacaggatggcgcttgagccagacgtgttgccgtgcttgcctttcatcccggctgacgagcagctcgggaattgataccgcatggtggctggcgagttcaggaagcaggtgcatggcttattccttcacctgatgcacaacatcgatcaccgagccatcgcggtaacgcacaacggcaacgacgcggtcggtgaattcaatcggctgtggttcaccggtcagcagacgcgcacgttcgcgcagccactcaatggaaaccactttaatgcccgcttcctgcagacgttctgccagttccggacgtgccgggttaactgcgataccgtggtctgtgaccagaatatcgacactggagcccggggtgatgcaggtcagcacgttatccaccagagtcggaatacgaccgcgtaccagcggcgcgacgatgatggaaagcgcagaggcaattgcggtatcgcagtgaccaccggaagcaccacgcagtacgccgtcagagccggtcagcacgttaacgttgaactgggtgtcaatttccagcgcgctcagtaccaccacgtcgagacgatcaaccgatgcgcctttcgaaccccagttagcgtactggttggcgctgatttcgatgtgattggggttacgggccagcgattgcgcagcatggctgtcaaagctctgcacatccagcagtttgcggatcagacctttttcgtgcaggtcaaccatcgtcgcggtaataccgccaagggcgaagtcggcgcgaatatcgcggctacgcattttgtcttccaggaaacgggttaccgccagcgatgcgccgccggtgccggtttgcatggagaaaccttctttgaagtagccagagttgacaatcacatccgcagcgctacgggcaataagcagttcgcgcgggttagtggtcatacgggtagcgccagcgccgatttttgcagcatcgccaacgcgatcaactttgacgatcagatcaacctgatcttgctcaatgcttgccggattatgcggataaggcagcagttcttcggtaagcatcacaacctgttttgcgttgtcggcatcaaccattgcatagccgagggagccgcagcaggctttaccggtgtagccgttggcattaccgaattcatcacaggacgggacgccgaggaaagccacgtcgatattcagttcgccgctctgtaccagatgcacacgtccgccgtgagagtggatctgcaccggttccgccagcagaccacgggagatctcttccgccagtggaccacgcaggccggaggtataaatgcgggtaaccacgccctggcgaatgtgttctaccagcggcgcatggcaatcactcagggagctggacgccagggtcaggtttttaaagcccatcttcgcgatgacgtccatcaccatattgacggtcaggtcaccgccacggaaagcgtgatggaaggaaaccgtcatgccgtcctgtaaaccagagcgacgaatcgcttcttccaggttggcgcacagtttgcgatcgcgcactttttcagcctggtaggtttgctttggtgagttctggaaagcggcaagatcgcattcagcgcgacgattccaggccgctacccgttcttgtcgttgagattgttcaattttctgcgtcattttgattgccttattcttcgcggatgccggaaagttctgcacgggagagcaccagacgggcgcgatcgataaccggaccgtccaccatcttgccgttcagggaaaccacgccgaggccttcgcgagcggcggcttcagcggcttctacgacgcggcgggcgtgatccacttctttctgggtcggtgcgtagaggttgtgcagcagatcaatctgacgcgggttgatcagcgatttgccgtcaaagcccagctgtttgatgtgggcggcttcttgcaggaatccagcttcgttgttagcgtcggaatagacggtatcgaacgcctgaatacccgcagagcgcgcggcctgcaaaatggagcagcgagcgaacagcagttcagttccttccggggagcgttctgtacgcaggttgcgcacatagtcttctgcaccgagggcgataccgatcaaacgctcggaagcgtgagcgatttccactgcgcgggtaatgcccagcggagattcaatcgccgccagcaggccggtgctgccgggttcacgaccacaggctttttcgatacgcaggatctctttttcgatatccagaacatcctgagcggtatcggttttcggcagacgcacaacgtccgcaccaccgcgaacgacggcttccaggtcgttgacaccccattcggaatccagcgcgttgacacgcacaatggtttcaatatcgcgatacagcggatgttgcagcgcgtggtaaaccatgcggcgggcggtgtctttttcacgcaatgctacggagtcttcgaggtcaaacatcagggcatcagccgggtagatgaaggagttgctgaccatcgcggcattggcaccaggcacaaacaacatgctgcggcgggtgcgagttttacgttgttgcagcgaagcggaaatcattggcaatcctcccatggcagagccgggataccgctggcgcgtgccagcagggcttccagtcgtgcacgtaaaatgcagtccagtgcgcctttgtcatcgacattcagctgtacgccgcgcacgttgtagcgggcgagaacgtccagaatggtggtgcgaattgcatcgccaaactgtttctcaacgctgctgttgatttgcaggtcgatatcctgcgtatcgagtggggcgatgcgtatcatcacatccccagactcaagggtgcctgcaacggcgggctggtttattttcatttttcacctgtttctcatgcgggggtcttttgacgagctgccgcgtcctggcgggagtgctcaagcaggttctgcaaataatgcagcgtgactgcagggaccagcggcgcgatagccgtgagatcgtttttcgccagcagttgacgtacccgggaagcggatatcggcatctcctggtaacgcagccgctcaatttcaaccagttcgatgggcggtgcggagatagtcggcgtttccagccagtagcgcatatcctggttgtactgggcggtaacgcgacaaaagggttcagtaccgacaaagcggtgagttacacccagtgcgggagcgaggtactgacggaaaatcttcagatcaatttcggtgtaacaatggttaatgacgctctgttctttaatgaagtagcaagggaacgtagcgcgggagatgatgtattcggagccgcgatgcacagtcaggcgtggaatatcggcggtgccttttaacaccagatccagccggtcttcataggggaagcgtgaagaatcttctttgactaaaaacagatgcaaccagtcgcactgtgccgcagcctgttgaatcagataacggtgaccattcgtaaagggattggcgttcatcacaatgcagccaatcttgttccctggatgacgaaattttttcagcgattcggcatagcgtttcagtcgcgtggcgctgttttccatcagcaccatcacgccgggtacgctggtcagcgtggaaaaaccgcactggcggaacagcgcctcgtattcggttttggtataaataaacagatgcgtgctgtgccgctcataggcgaggtttatcagttcagtggctaatgtcagcgccagtccttcaccgcgaacggattcactgatagcaacgcatttaataatatttccggcaattccaccgcacgcgataagcttttcatcgcgggttacggtaataaatacttcgactgtggtgtcaacgctcaaatcattttcatgcaggaattgggcgatttccgccatttttttattttctgaacgttttacgcgggtgaaaatatcattgccgaacataataaatagtatcctgaaggtgcatgttgttatcgatttgcaacgaatgttgttcaatgttgcaaactgataactttttattttcacttgggagaaaggtgggtgatcgaggtatatctttttctcctttcgctatacatcctaaggagtatttcggcgtgaaattttgatttatttcacatagagttagtggttttttatttatttaatggttttaagttttttaattaatgtaattacgaaatgactcgcaggtttaagtgatttaattgatttaatgaataaaatttgccacgatcataattaatatctatgtattttgattcaacattttaattacatccgtcaaagaggctcgggacaacccgcaaggaaaacaatgttgcagcttaacgagaataaacagtttgcatttttccaaagactggcatttccgctgcgtatctttttgctgattctggtgttctcaatatttgtcattgcagccctggcgcaatattttacggccagttttgaggactatttaacgcttcatgtacgcgacatggcaatgaatcaggcgaaaattattgcctccaatgacagtgtcatctctgcggtgaaaacgcgtgactacaaacggctggcgaccatcgctaacaaattacaaagagataccgattttgattatgtggtgattggggaccggcactcgatccgcctttaccatcctaatccggagaaaattggttatcctatgcagttcaccaaacagggcgcgctggagaaaggggagagctacttcattaccgggaaagggtcaatggggatggcgatgcgcgccaaaacgccaatctttgatgacgatggaaaagtcatcggcgtggtgtcgattggctacctggtgagtaaaatcgatagctggcgggctgagtttttattaccgatggcaggtgtgtttgtcgtgctgttagggattctgatgttgctgtcgtggttcctggccgcgcatatccgtcggcagatgatgggcatggagccaaagcaaatcgcacgcgtggtccgtcagcaagaggcgctgtttagttcggtttatgaagggctgattgcggtggatccgcacggttacattaccgccatcaatcgtaacgcaagaaagatgctggggctgagttcccccggacggcaatggttgggtaaaaccattgctgaagtggtcaggcccgccgatttctttaccgaacagattgatgaaaaacgtcaggatgtggtggctaactttaacggtctgagcgttattgccaatcgggaagctattcgttcaggtgatgatttgctgggggccattatcagctttcgcagtaaagacgaaatttccaccctcaatgcgcaactgacgcaaataaaacaatacgttgagagccttcgtacattgcgacacgagcatctcaattggatgtcgacgctcaatggtctgttgcagatgaaagagtatgatcgcgtgctggcgatggtgcagggggagtctcaggcccagcaacagcttattgacagcctgcgcgaggcgtttgccgatcgccaggtggcggggctgctttttggtaaagtgcagcgcgcccgggaactggggctaaaaatgatcattgtccccggtagccagctttcgcaactgccgccaggactggatagcaccgagtttgcagccattgtgggcaatttacttgataacgccttcgaagccagcctgcgtagcgatgaaggaaacaagatcgttgaattattcctcagcgatgaaggcgatgatgtggtgattgaagtcgccgatcagggctgcggcgttccagagtctctacgagacaaaatatttgagcagggggtcagtacgcgtgctgacgagcccggtgaacatggcattgggttgtacttgattgccagctacgtaacgcgctgcggtggtgttatcactctcgaagataatgatccctgcggtaccttattttcaatctatattccgaaagtgaaacctaatgacagctccattaaccctattgatcgttgaggacgaaacgccgctggcagagatgcatgcggaatatattcgtcacattcccggattcagtcagatattactggcgggaaacctggcgcaggcccgaatgatgatcgagcgttttaagccggggctaatcttgctcgataactatcttcctgacggcagagggattaatttattgcatgaactggtgcaggcgcattatcccggcgacgtggtgtttaccactgcagccagcgatatggaaacggtgtctgaagccgtacgttgtggtgtatttgattatctcattaagcccattgcctatgaacggctggggcaaacgctaacccgtttccgccagcgtaaacatatgctggaaagtattgatagcgccagccagaagcaaattgatgagatgtttaatgcctatgctcgcggtgaacctaaagacgaactgccgaccggcattgatcccttgacgctaaacgcggtgcgaaaactgtttaaagagcctggtgtgcaacatacggcagaaacggtggcgcaggcactgaccatcagccgcaccactgccagacgttatcttgaatattgcgccagccgccatctgattattgctgaaattgttcacggcaaagttggcagaccacaacgcatataccacagtgggtgacatgataaagccggaggaaacttgcctccggcattactatttacttgcctgtgaccgctgctgccgttcctggcaccatcagctctgtagcaacgataacaatcaccaaaccaacaagcaccggtaccgaggtgcgttttacgacttcaaacggcgagatcttcgccatcccggcaaccgcaacgactacgccagaaacgggcgaaagggtacggccaaggtttgacgcctgcagcatcgggatagtcaaatacgccgggttaatgccggaagagtgcgccagtttcgggatcatctcaacaaacgcataaaacggcgcattgcctgaaccggtcgtgactgccgccagcattgtcagaatcaccaataccagcatcaggatgatactcgccgaaccaaacgaggtagcgatagaaatcagactttgaataaagccgatggtgctaagcccctgagcgaataccccagcggcaaccagcagcatcaccacgttagcaaacgcatctgccatcccgcgataagccacttccagaccagagaaaactttctgggtattaaagctgcggaggaactccagaatggaggcaatcagcatacaaatcaccagaatagtgatgatgtgtaattgcggaccccatttaccgtcaaaaatcagtacaccgatgatcggcgtgaacggcaaaatggcataaaacgcaggagcagtggtggtgatttcactgacatctaacatttcatgagagatgtgctcttttttatccagataacgttgccagaagaagtgggcgatcgccatgccgataattgcagcaattgagataggcagcgtcgttttgaaggcgaagtcaatcagcgacatttcggaagcttgcgccgccagcaccacatcccctgaagtcggtgcgagaataatcgccgccggggaggcacaaatggcagcagctgcgccacgactgataccaacgtttaccatcaccggaaatagggttgccatcagcaaaacacccagaccggttgcggaagagacggccagagacatcagacaggcgacaaaataggcggcaatcatcagcaggtaaggggagttaatatactgcaatggttttgacgccagcttgaccaccatatcattcgcgccgatatgggtcatgtaagcggcaaatccacacagcatcataatcatcatgccgaggtcgccgccgcggctcattagtaatattttaacgtattcaacgatatccgtggcgctgtagcctgttgaagcctggctggacggtaacactttgtgccccataatggcactgataatcagcaataacaggccaccgacaaataacacaccagtggcggaataccctttaatgatgtagcgagctacacccacaataaccacaaccccaataaggagctcaatgaatgtcagcataatttttcctgtctccaggccccaaagtaaataataaaaaattcctaaagcttaaggaaaaaatatgcccaataaattggcgatgaatgctgattaaaatcaagaaaaactgccattaagacattgaagttgctgtttttatacatagataacaaaacgcatatttagcggttggcaattatcacataataatgtgtgcaaattgatggtggattgatgcaaatttgttaattgcaatggtgttagctgcggctgtgcgctcaaaaaataatctaatatgagcataggttgacgatatatattatatgcttcgttaagatgattgttgtatctcgttaaaaaataaaataatttttccttgattgcattttgtcatcaaaaatgacttggtttttcttttttgactattcccatcgcagaaaacgacgcatcatctttaatcgatgcgcggaaatatttaacttgaacaagcggaaataaatagagcagctattcagattattctttatgttgggtctattaaggttatgttaattgcagctttgctatgctagtagtagatttttgataaatgttttatggtcacaaatgaacgtgagtaaatatgtcgctatcttttcctttgtttttattcagttaatcagcgttggtaaagtttttgctaacgcagatgagtggatgacaacgtttagagaaaatattgcacaaacctggcaacagcctgaacattatgatttatatattcctgccatcacctggcatgcacgtttcgcttacgacaaagaaaaaaccgatcgctataacgagcgaccgtggggtggcggttttggcctgtcgcgttgggatgaaaaaggaaactggcatggcctgtatgccatggcatttaaggactcgtggaacaaatgggaaccgattgccggatacggatgggaaagtacctggcgaccgctggcggatgaaaattttcatttaggtctgggattcaccgctggcgtaacggcacgcgataactggaattacatccctctcccggttctactgccattggcctccgtgggttatggcccagtgacttttcagatgacctacattccgggtacctacaacaatggcaatgtgtactttgcctggatgcgctttcagttttgagacaaatgaagttttagtaacttctttaaaatcaataactaaaataagtagcatcaaaaataacgcgacttttatcactttttagtaaagttgcactggacaaagcgtaccacaattggtgtactggtaaccgacacagcatttgtgtctatttttcatgtaaaggtaattttgatgtctaagattaaaggtaacgttaagtggtttaatgagtccaaaggattcggtttcattactccggaagacggcagcaaagacgtgttcgtacacttctctgcaatccagactaatggttttaaaactcttgctgaaggtcagcgcgtagagttcgaaatcactaacggtgccaaaggcccttctgctgcaaacgtaatcgctctgtaagatacgtcagcaagaattcaaaacccgcttaatcagcgggtttttttttggtctttagtgtgcggttgaggccgaaaacagccagaaagccagtgctgtcatggcaaaagaccccagaaggttgacgaaaacgttcagtaacgcccagccaaagcggccctcttgtaacaaaaacaccacttctgccgaaaatgttgagaaggttgttagaccgccacaaaatccggtggtgattaatactttccacactggatcaatgttcgtcatcctgctgaaccaggcgaatcccattcctatgatgaatgccccaatcaggtttgctgccagcgtccccaacggaatcgcctgatgcagcgggttaaatcgcatacttaacagccatctcgccacgcttcccgtaccaccgccaataaaaactgctaaaagaagttgtaacactgcaaaatcctgctatttgatttgtatgagtgataagtgtaacgccgaataatcgtcgttggcgaattttacgactctgacaggaggtggcaatgctggttgccgcaggacagtttgctgttacatctgtgtgggaaaagaacgctgagatttgtgcctcgttgatggcgcaggcggcggaaaacgacgtatcgctgttcgtcctgccggaagcattgctggcgcgcgatgatcatgatgcaggtctatcggttaaatcagcacagctgctggaaggcgaattcctcggacgtttacggcgagaaagtaaacgtaacatgatgacgacaattctgacgattcatgttccttcaacgccggggcgcgcatggaatatgctggtggcgctacaggcaggaaacatcgtcgcccgttatgccaaattgcatctctatgatgcatttgccattcaggaatcacgccgtgttgatgctggtaatgaaatcgctccgttactcgaggtggaggggatgaaggtcggtctgatgacctgttatgacttacgctttccagagctggcgctggcacaggcattacagggagctgaaatcctggtacttcctgccgcctgggttcgcgggccgctcaaagagcatcactggtcaacgttgcttgccgctcgtgcgctggataccacctgttatatggtggcggcgggggagtgcgggaacaaaaatatcggtcaaagccggattatagatccctttggagtcaccattgcggcagcgtcagaaatgcctgcactcattatggcggaagtgacgcccgaacgtgtgcgtcaggtgcgcgcgcaactgcccgtcttaaacaaccgtcgctttgcgccgccgcaattattatgatgtttttttactcggcgcttgattcaccttgttacagattgctattgtgtgcgcgcgtcgaatgaccgttaatattctctggtttttaaggcgcgttctgttgccggttatatgtcaagaaggtatctatgggtgagattagtattaccaaactgctggtagttgcggcgctggtcgttctgctgtttgggactaagaagttacgtacgctgggcggagaccttggagcggccattaaagggttcaagaaggcgatgaatgatgatgatgctgcggcgaaaaaaggcgcagacgttgatcttcaggctgaaaagctctctcataaagagtgacgtggcgagcaggacgctccctcaatatcttgttcgatacaaaaaacccgcttcaaaaagcgggttttttatcagacagatgtaagtaattattacaggattacttaacttccatccctttcgcctgcaaatcggcgtggtaagaagagcggacaaacggaccgcatgcagcatgggtaaagcccatcgccagcgcttcggctttcatttcgtcgaactcatccgggctaacgtaacgttgaaccggcaggtgatggcggcttggctgcaaatattgccccagcgttaacatcgtcacaccatgacggcgcaggtcgcgcattacctcaataatttcttcattggtttcacccagtcccaccatcagaccagacttggtcgggatttccggatgcgcttctttaaagcgttccagcagcttcagcgaccagttgtaatctgcaccaggccgtacctgacggtaaatacgcggtacgttttccaggttatggttgaacacatctggtggcgttgcagtcagaatatccagagcacgatccatacgaccacggaaatccggcaccagagtttcaattttgatttgcgggcttttttcccgaatggcagtaatgcaatccgcaaagtgctgggcaccgccatcgcgcaggtcatcacggtcaacggaggtgataaccacataacgcagcgccatatcggcaatggtctgcgccagtttcactggttcattggcatcaggagctaccgggcgaccgtgggcaacatcacagaacggacaacggcgggtacaaatagcgccgaggatcataaacgttgctgtgccgtggttgaagcattccgccaggttagggcaggaggcttcctcgcagacagaatgcaggccatttttgcgcattgcggctttgatgccctggatacgtgtagagtccgctggaagcttgattttcatccattccggcttgcgcagcagggcttcgcgctctgttgccacgtttttaaccgggataagggccatcttatcggcatcgcggtatttaacaccgcgttccatcacaatgggtttactcatagcgtgcgtgttccagttgcgaattacgaaggaaagcgtttcaattcaatagattgttgtaattatcaactatttttgaattaacgactggcagtatatcattgaaacggacctgaaagcagccaaagcggtcgcgaaaatgtaaaattgttgttggattgtgccattttatcgttctgcgctgtgatctggctgtaacaatactttttcaaaatgcattacggataacatctattactccgtgcaggatgggatcacgcaggctgaatttgttgtagtggatagagaaatctatttgctcctcatttaaggacggaaaaggcagtttttccagcggccagcagcggctaaacaggttataaaaacggctgggaataatcgctaacatgtcactgttggcaaccagtgcagcgattgtcaaaatgttgtagctggtgaaattgatttgccggtccggaaacatttcttgaactctctgccgcagaccgctgaaattttgctcttccggtaacagaagtacatgcgcagcgttgtcgatagtctctctgtcatcttctaaagagagtagtggatttccctcgcggcaaattaacaccatattgtcggtgaacagaacatgatgttgcaccgtacgattggtgcaaaacatgttatcgatgatgagatcggtttgaaactgactgagttggttttccgcgtcgctgatgggcgggttgcgcagtaaaagctgcggatagtgagttttaatcgcccgatagatgacaggaaggaccagggctccgaccgagggagtggtcgcaatagttatcgttcgttgcttatcatagcttccttcgatatccagcgcgccaagaatggactcaaggccctgactgatatactcatgtagatgcatcgcaaatgcggtaggagtgacaccctggcctttgcgaataaacaatgggtcagggaatataacgcgcagtttctgaatagactgactgattgccgagggggtcagattaagcactttcgctgcattaacgatccctttatgtacatatacagcttcaaaaatagtcagaaggttaagatcaatatttcgtaaggttgtaaatatttgtggtttaccttctgacgactttctgcttaaacagggttcaatttgattattactatccacgcacttactccaattttattcatggaaaaataatatttaaaaaattacaataatcttatgtctaattggaacggaacgcttttgctcaccataatcaactatttcaataggttaatcaatggggtgagttacggagcaaggcgtggcaccgcatttctgcaagtgataaagaaaatatacaaacgcgaaggagatgtaaagcattagcaggtattatgagtaatgacccagtgtaaattgggccattgatgtatggaattaagcggtaatatattcgaagtccggattgtttagtagcgctaaaatattttccagtaaacgtggagcaatattattagtcgtcgcttcgggtttccattgtgatattttagccatttccattccggcatacccacaaggattaatacgtaaaaatggtgaaagatccatattgacgtttaatgccagaccgtggaatgaacaaccgcgtcgaatacgtaaacccagtgagcaaattttcttttccccaacatagacacctggcgcgtcagcccgaggatgcgcttctatacccagttcagccagggtattcaccactgtttgctcaagcaaggtcaccagttcacgcacaccgagtttacggcgtttcaggttaagcaacacatacatcacctgttgccccggcccgtgataagtcacctgcccaccgcgatcgctctggatcaccggaatatcacccggcattaaaatgtgctccgcttttcctgcctgaccttgggtgaataccggatagtgctcgaccagccagatttcatcaagggtactatcatcgcgggtatcggtgaattcatgcatagcctgggagattggctcgtaaggctgaagaccgagctggcggacaagaattttatcctgatacaaaacggcatctccgtggagaatgagtaaaagtgggggaaaagtatatcacagcgaggagaggggagttacccgaccaggagccgggtaacggagaagcgagttacagaaccatgcggacaatatcgattttgcccagttcttcatacagtgtttcaacctgctcgatatgagtggcgttgatagtgatagataccgagtggtagttgcctttgctgcttggttttaccgttggggtgtagtcacctggcgcatggcgctgtaccacttcaaccacctgatcaaccagctcaggtaacgcctgccccataactttgtaagtaaaaggagtagggaattcaagcagttcgttaagtttggttttcatgtcagctccggcgtaacgtaattaaatagcaactcccgccagaaggcgggagtttttttactgatgcttagtatatggggacggaaattacactttcaagtgttcaatttttaaccaaaccagtgatggaacattaatttaatgtaatcaatgattttgccgaagaagttaccttccgggatttcttgcaacacaaccagcgggcgttgctcgatcgttttgccatcaagctggaagttgatagttccgacgacctgattcttttgcagcggcgcatgcaattcactgctgttcagcacatagctggctttcagatctttcatgcgaccacgcggaatggtcaggtacacgtctttatcaacccctaacgaagcgcgatcagaatcaccaaaccaaaccggttcagaggcgaactctttacctactttcagtgggttaacggtttcgaagaaacggaagccccaggttagcagttttttactttcggcttcacggcctttaaaagtacgtccgcccatcaccgcagaaatcaagcgcatctggccttcagtcgcagaagcaacaaggttgtaacctgctttgtcagtgtgtccggttttgatgccgtcgacattcaggctgttatcccataacaggccgttacggttcagctggcgaataccgttaaacgtaaattctttttctttatagatcgagtattcattcggtacgtcacggatcaatgcctggccgatcagcgccatatctcgtgcggagctgtactgaccatcagcatccagaccatgtaccgtctggaagtgggtgtttttcaggcccagggcgttaacgtagctgttcatcaagccaacaaaagcgtcctggctaccagcggcaaaatcagccatggcgacacaagcatcgttacccgattgcaggttaataccgcggatcagctgagaaaccggaacctgcatgcccggtttgaggaacatcagcgaagaacctttaaacaccgggttaccggtggcccatgcgtcgttgccgatagtgactaaatcagtttctttaaatttaccggctttcattgcttggccgataacgtaactggtcatcattttggtcaggctggcaggatcgcggcggacatctgcgttctgttcggcgagcactttgccggagttatagtcaatcaggatgtaggactccgcatcgatctgcggtacacccgggatcatagttttgatattcaggtcatcggcatgtgcagcagagataaaggctgtgcaaagagccgtggtgagcgccaggcgcttcatgatacgagcggaaaaaatggtattcatggtctgaactacgacatccgtgatggaattaaaaaaagtgccctactatagcaaatgcactaccggcaggcatctgactttccgcgtgactttgttaacgtcatttacagaaattgacacatcagatgcctgctttacgctactgcgcggtggtaataaatgactgtaattgggcttcggtttgcaaacgttgctgcaaggtactggcttcggctttgctggcgaaggggccaagctggatccgccagaccgcgccattttgagttacgcgaccggggacgccgaacttctgtcccagttgctgttggtactgttgcgcacgagcctgatcgctaacggccccgacttgcaccataaagttaccgctggcgctttgcgaggcggcttgcggtgtcaccattgcaggcgaggttgcaggcgttgtcgacggagctgtaacaacgggctgtggcgcaggcgtcggttcgctgccttccagtacaccaggcgctaaggtcgttggtgcgccgaggaaaccgctactggttaccggcgcgccggtcggatcttcgctttttagcgtcgaattactgaccggaagaatgtcaccctgcgggccagacactgaacttgttcccgcgccaccgcttaaatcgggaggtgcaggcagggcgtaagtctgtttggcgactgtggtacaagccataccaggaccagaaagcgaaccatcctgggcgacaataatcggatcgatacgaactttggtgttgtttgacgtgttaagacggtcagctgccgcgcgagaaagcgaaataacgcggtcgttgccgtaagggccgcgatcattaatgcgcaccacgatcattcgcccgttagccaggttagtgattctggcgtagctggggatcggaagcgttggatgggccgccgtcagctgtgtcggatcgaaagcttcgccagaggccgtcaggttactgcctggttcggcatcatagattgccgccagtcccgcctggctaaatcgagacggatcctgcacgattttgtagcttttaccgtcgcgctggtaatcctgatttgccgtcgcgttcagtggttcgaaacgcgggtccgccccgctaatttcaactatggggccgttacataccgcaggctgcggtacacttaccgtctgttgctgaccatcatcgcttgtacatgccgcgagcattcctgccgcgatgcagatcccgagccactgcttacgcattgcgcacctcttacacgcttttcgacaacattttcctgtgggtgtggattgacattacaatcccgaacccagccatcagcacaattagcgccgatcctccataactgaccagtgggagcggaacccctacaaccggcagaataccgcttaccataccaatatttacgaagacataaacgaataatatcagcattaagccaccagccatgacgcgaccaaaggtggtttgcgctctggcggctatccacagcccgcgcatgatcagcagaatgtagagagcgagcagaatcagaatgcccactaatcccagctcttccgccagtaccgcgaagataaagtcggtatggcgttcggggagaaattcaagctgtgactgagtgccgtgcagccagcctttgccgcgtaatccgccggagccaatagcaattttagactgaataatgtgatagcccgcgccgagtgggtctgattccgggtccaggagcatcattacgcgctggcgctggtaatcatgcatcaggaagaaccacagaatcggaatgaacgccgccaccagcactactgcgacgccaatcagacgccagctaaggccagagaggaacagtacaaacagaccggaaagcgcaacgaggattgatgttcccaggtcaggctgtgcagccaccagcagcgtgggcataaatatcagcaccagcgcgatgccagtgttcttcaacgatggcgggcaaacgtcgcggttgataaagcgcgcaaccatcagtggtacggctattttggcaatttccgacggctgaaaacgaacaataccgaggtccagccagcgttgagcacctttagagatggcaccgaaagcatctaccgccaccagcaaaataatacagatgatatagagatagggggcccagccttcataaacgcgtggaggaatttgcgccatcaccaccatgatgaccagacccatcgcgatttggccgattttacgctccatcatgccaatatcctgaccgctggcgctccagataaccagggcgctgtaaaccagcaatgccagtaagatcagcagcattgtgggatcgagatggactttatcccagaatgtttttttattcggattatccgtcatgattaatggtcctccgctgcggcaaccgctggattttccgcaggcagatcggtgttgttatcacccagcataatgtggtcgaggatctggcgcatcagtgtaccaaccgccggacccgcaccaccgttctccagaatcatggcgacagccacttgcggattgttgtatggcgcaaaggcggtcatcagtttgtggtcacgtaaacgctcggcaattttgtgcgcattataggtttcgttcgctttcagaccgaagacctgagcggtaccggatttcgccgcaattttgtacggtgcgctggcaaagtatttatgcgccgtaccgttagggcggttagcaacaccgtacataccgtctttcgccagctcccagtaaccggaatgaatatcgccgacgggcggttcatgcggctgtacccatggcacctgtttgccgtcttcggcggtgctcatcagcaaatgaggaaccttcacgataccgtcattaatcaggatcatcagtgccttactcatctggattggggtcgctgtccagtaaccctgaccgataccaaccggaatggtgtcaccctgataccacggttttttaaagcgtttctgtttccattcgcgggtaggcatgttgccggaacgttcttccgccaggtcgataccggtgtaatgaccataaccgaatttacccatccattcggagaggcgatcgatccccatatcgtaggccacctgatagaagaaggtatccgcagattcttccagcgatcttgtgacattcagacgcccgtggccccattttttccagtcacgataacgtttttccgaacctggcagttgccaccagcctgggtcaaacagcgtcgtattgcgcgtgatcaccccggcgctcaatgccgaaaccgccacatagggtttaactgtagacgcgggaggataaaccccctgtgtggcgcggttcaccagcggtgtattcgggtcgttcaacaaggcggaataatctttgctggagataccgtcaacaaacaggtttgggtcataactaggcgtggaaaccagcgccagtaccccacctgtacgcggatcggtgacaaccacagctgcgcggctacccgccagcagcgtttcaatatattgctggagtttgagatccagcgtcaggtaaatatcgtgtccggcttgcggtggtacttcttttaactggcggataacacgcccacggttgttaacttcaacctcttcataaccggtctgaccgtgcagcacgtcttcatagtaacgctcaatgcccagcttaccgatatcatgcgttgccgcatagttggccagtttgccgtcattattcaggcgttcgacgtctttatcgttgattttcgacacatagccgatgacgtgggtcaacgccgaaccgtaaggatagtaacgacgtttatagcctttaacttcgacacccggaaaacggtactgattgacggcaaagcgagctacttgtacttcggtcaggttagttttcaccggaatagaggtgaaacggtgtgaacgtgcgcgctcttttcggaatgcagcaatatcgtcatcggtcagatcaaccacgctgcgcaaagcgtccagcgtttgctgcacgttatcgactttctctggcatcatttctatctggtagatagtgcggttgagggccagagggataccattacggtcgtagataatgccgcggctgggcgcgataggcaccagcttaatgcggttttcattagagcgagtctggtagtcggtaaagcgaacaatttgcagattatacaggttggcgataagcacgccggtcagcagcaaaatccccaaaaaggcgaccagcgcccggcgcacaaacagcgcggactctgccgtatagtcgcgaaaagagttctgtagtttcatccgctgcgttttctactcaaagctcccttatcactcacggtgataaggatggttggtggtgatgctccacgcccggtacagactctctgcgaccagcacgcgaaccagcggatgggggagggtaagcgccgacagcgaccagctctgctccgccgccgctttacaggcaggcgacaacccttcaggcccgccaatcagtagactgacgtcgcgaccatccagcttccagcgttccagctcagcggctaactgcggcgtatcccagggcttgcctggaatatcgagggtgacaatgcggtttttgcctgcggccgccaacatctgctcaccctctttgtcgagtatgcgcttgatgtccgcattcttgccgcgttttccggccggaatttcaatcagctcgaagggcatatctttcggaaaacgacgcaggtactcggtaaaaccggtttgtacccagtccggcattttcgttcccacggcgacaagttgcagcttcacgcattaactccagagtttttccagttcatacaggcgacggctctcttcctgcatgacatggacaatcacatcgcccaaatccacgacaatccagtcggcgctgttttcaccttctacgccgagcggtaacaggcccgctgcgcgagactcctgcacaacgtggtcagcaatggacataacatgacggctggacgtacccgtacagatgatcatgcagtcggtgatgctggatttgccttgaacgtctaaggcgatgatgtcctgacctttgaggtcatcaattttgtcgataacaaaatcctggagtgctttaccctgcaagttttccccctgggtgaatcaaatagataaaaatggtctgtcagtatacctgaaccagaggcgatttcgggacaattgtcgccgaatcggctttcgaaagtgggctatcatcccaccccgcgccgcagattgcatcgccatttttgtaaaacaatttctacaaagtcgtgtctggcggaaaaagtctggctgcggagaatatcagcctgcccggggctgtcaatggtcgttgcggcttacccgtaaaaaaacagataagtcatgcattctcgaccccgatggcacggctattgaggacgcgtagcgtcgcgaatttttggttgatatcaatggcgctccaacacccctggtcaacgcgaaaatgccacatagactcggcaggcatgccaattaaacgagcaattaacagactcagtacgccctgatggctgacgattaaaatattctgatagtgctgatattcactaagccttgcgataaagcgttccacacgttgtgaaaatgcctgaaatccttcaccgttcgtggggatagcatgctgccagtcattgcaccacgcgctatagttttcggcatcttcttgcatgaggtcgcgatgatgtcgcatctcccagtcaccaaaaaacatttcgttgagttcagggatgatatgaacggggagctggcggtcactgagaaccagtcgcgcggtatgctgtgcccgttccagttcactgcataaaaccaggtcaaaggaaacatcatgtagcagtgtatgcagattttgcgcttgctcaataccgcgtgcggtcaggggtgtgggcgcatgaccgctgtacagaccatcgacattcgcttgtgtttcgccatgacgaattaaccacagtcgcatcatgccctccgtaacgacaggtatcagcgatacaagccttgttggttaatgtaagtcaataccggttccggcaataaatcctcacacgattcaccgttttgcaaacgttcgcggatgatggtcgccgagatgttaaaccacggtgtttcagccagataaattttaccggcaggctgaaggtgaagatcttccgggttatgtgtcaaatgatcttccagccattgctggtattgcggttgcgccatttcaagtgggtaacctggacgccgacagacgatcaaatgtgcattgtcgagtatcgtttcgtattcgtaccaggtcggaaaggtcagcaatgaatcctgaccaataataaacgccagcggcacgtccggcccttgttcctgccgccactctttcagtgtttgcgcagtgtaagagggggcattgcgctttagctcgcgttcatcaagagtaaataatggcttgtcggcaatcgccagttcaagcatgtgtttacgctgcacgctgttcgcttccggctggggacgatgcggaggaacattattagggattattgtgacccgcgtcagaccaatcaaattcgccagcgtttccacgggtttaagatgaccatagtgcaccggatcaaaggtgccgccaaacagagcctgtaaagatttcatatcaaccgtcgataaatacgtccgccaggggtttatggcacaacagaagagataacccttccagctctgcccacactgactgaccgtaatcttgtttgagggtgagttccgttcgtgtcaggagttgcacagcctgacgtaactgcggctggcttaagcgatttaacgcctcgcccatcatgccccggcggttctgccatacccgatgcttatcaaacaacgcacgcagtggcgtatgggcagactggcgtttcaggttaaccagtaacaacagttcacgttgtaatgtgcgcaacaaaataaccggctcgctgccttccagacgcagttgctgaagaatatgcaacgcgcgcttactttttcccatcaacaaagcatcaacccaatgaaaaggggtgaaatgcgcggcatcattcaccgcctgttcaacgcgcggtaatgtcaatttgccgtctggccagagcagcgataaacgctccagtgcctgagccagcgccagcaggttaccttcataacagtagcagagcacctgattcgccgcgtcatccagttctaaattgagctgttttgcgcgcgcagcaacccagcggggaagctgagcctgctccggtgtctgacaggtcacctgcacgctgcgattcgcaagagcagtaaaccaggcggaattttcttgcgctttgcttaatttattaccgcggacgatcaacagcaggtcgtcatgcagaagtccggtgagtgtgagaagttgttcattgatcgccgcattcggtccgttttctggtaacaacagcaatagcgtttgtcgactggcaaacagactcatggcctggcataacgaaaagatcgcattccagtcagtgttgggatcaatggaaaaagtgtggtgttcttcgaatccttgtgccgcagctacctgacgaacagcgtcctggctttcctgcaataacagaggatcgttaccaagtaaaagatacgccgcgcgcagcccttcattgagctgcgcgcggagttgttccgggtacaaccgaatcatcagttacccagcgtggtggagacgcgtgcaggcgttgccggagtatccgttgtggtcgacgtctgttcttcgtcggaacgaatatccgcagcacggatgcttggcagcttacgaatcagctgttcggcagcacggtcgtacatctcttttacgatcatgtcttgttcgttatctttcgctaacgccatttgcgggttatcgaagaacgaacggaagactttggcgctaatcgggtagatatcacggccggggatcaacacggtcgcattaaccgtcatgatcatctgatactctgctgtttgaccgttacggaataccgatgcggtatctttcgcgatgctcactttacccaaacgcaaggatggaacgtccttacgcgtggtttctttatcaagcaactcgacaccattcagacgtaactggttacgcaccgcacggcttaatggcccgttcggatcgcctgagtccaggatcatgaccttcatagtggaaggaacctgcgtggtatcacgcagatgccagccacacccggcggtgattaacaccgccagagataacaacaatgttgccagatatcgcacgcttcctcccgcgcttagccaacgaccagattgaggagtttacctggtacgtaaatcactttacgtacagtaacgccatcaagatattttgctaccagatgttcctggccagcacgttcgcgaacctgttcttccgttgcgtccaccggaacggtgattttggcacggactttaccgttaacctgcaccacgaccagcgtggagtcttccaccatcgctttttcgtcagcaaccggccacggcgcgttgtcgatatcgccttcgcctttcagttcctgccacagcgtgaagcagatgtgcggggtgaacgggttaagcatacggacaacggccagcagagcttcctgcatcagagcgcgatcctgctcgccatcggtcggtgctttcgccagtttgttcatcagctccataatcgccgcaattgcggtgttgaaggtctgacgacggccgatatcatcggtcactttagcgatagttttatgcacatcacgacgcagcgctttctgatcttcagtcagtgcatcaacgttcagtgtcgcaacatcaccttttgctgtatgctcgtacaccagtttccagacacgtttcaggaagcggttagccccttctacgccggattcctgccattcgagagtcatatcagccggagaagcaaacatcataaacagacgaacggtgtccgcgccgtaacgttcaaccatcacctgcgggtcgataccgttgttcttcgacttggacattttgctcatgccggtataaaccagttcatggcctgccgcatctttcgctttcacgatacggcctttctcgtcacgttcaacgatagcatcaaccggggaaacccagttacgttcgccgttttcgccaacatagtagaaggcatctgccagcaccataccctgacacagcaactgtttcgctggttcgtcagagttcaccatgcctgcatcacgcatcagtttgtggaagaagcggaagtagagcaggtgcataatggcgtgttcgataccaccaatgtagatatccaccggcagccagtagttagccgctttagaatccagcataccttctttgtactgcgggcaagtgtagcgcgcatagtaccaggaggactccataaaggtgtcgaaagtgtcggtttcacgcagcgctggcataccgttaacggtagtttttgcccactccggatctgctttaatcgggctggtaatgccgtccatcaccacatcttccggcaggatcaccggcagctggtcgtccggggtcggcattacggtaccgtcttccagcgtcaccatcggaatcggcgcgccccagtaacgctgacgagaaacaccccagtcgcgcaggcggtagttcactttacgctcgccaacgcccatcgcagtcagtttatcggcgatggcgttgaaggccgcttcatggtcaagaccgttgaactcgccagagttgaacagcacgcctttttcagtcagggcttgctgggagagatccggttcagaaccgtcagccgccagaataactggcttgatgttcaggccatatttagaggcaaactcgtagtcgcgctggtcgtgacccggaaccgccataactgcgcccgtgccgtactccatcaatacgaagtttgctgcccaaacgggaatttcttcgcccgttaatgggtgaaccgctttaaagccagtatcgacgccttttttctccatcgtcgccatttcagcttcggcaactttggtattacggcattcgtcaataaaggctgccagttcaggattattttctgccgctttctgcgccagcggatgacccgccgctaccgccaggtaggtacaacccataaaggtgtccgggcgggtagtgtaaacggtcagcgtgttgtcatagttgttaacgttgaaggtgatttccacgccttcggaacgaccgatccagttacgctgcatggttttaacggtgtctggccagtgatccagtttatccagatcgttgagcagctcgtcagcgtaagcagtgattttgataaaccactgcgggatctctttacgttcaactttggtatcgcagcgccagcagcagccgtcgataacttgttcgttcgccagtacggtctggtcgttcgggcaccagttgaccgcagaagtcttcttatataccaggccttttttatacagctcggtgaagaatttctgttcccaacggtagtattccggcgtacaggttgccagctcgcggctccagtcataaccaaagcccagcattttgagctggtttttcatatacgcgatgttgtcgtacgtccacggtgctggcgcggtgttgtttttcaccgccgcgccttccgcaggcagaccaaacgcgtcccagccgatcggctgcaggacgtttttgcccagcatacgctggtagcgggcgatcacgtcaccgatggtgtagttacgtacgtggcccatgtgtagtcgaccagaaggatagggaagcatagacaggcagtaatacttctctttgctctcgtcttcggttacttcaaatgtgcgcttctcatcccaatgaagctgtactttggattctatctcttccgggcggtattgctcttgcatggcagccagtggtcctgttttcaatacggctacaaatgtagcgttgaggtggtttttcagatccgcatagcatagcccaaacgtccgcgtcaaaacagcctttcgcgcactcgacgttgaaatgatgcccggattattcatacattaatttacagagtttgtgggcgtattagcaaagcaaggaacaaagaacgtctattattatagtcagttaacgacccgggagatgaaacgatgaacaaggttgctcaatattaccgtgaactggtcgcgtcactgagcgaacgcctgcgtaatggcgaacgtgatatcgacgcactggtggaacaggcgcgcgagcgcgtaataaaaacaggggagttaacgcgaaccgaggtcgatgagctgacgcgagctgtcagacgtgacctggaagagttcgccatgagctatgaagagagcctgaaagaagaatctgacagcgtctttatgcgggtgattaaagaaagcttgtggcaggagctggcagacatcaccgataaaacgcagcttgaatggcgcgaagttttccaggacctcaatcatcacggggtttatcacagcggagaagtggtagggctgggaaatctggtctgcgagaaatgtcacttccatctcccgatctacacaccggaagtgctgatgctatgcccgaaatgtggtcatgatcagttccagagacgcccgttcgagccgtaatgaatggtgccggatgacgtaatgtcatccggcgagttgttaagcgtaaaatttcagacgatcagccagtaaatcaacaaagccctgacgatcaacatcgaccattacagttgcattcggtttattgccagtcagataataataatcaacaaccgtcataccctgggtatatttcccttgtgtttccacgccaacccagcgctcaacagtggtaaacaactccggtttcaacagccaggcgatggtgcatgggtcatgcagcggtgcgccgacaaagccccatttttcgtctttatgatattcgaggaagaaatccagcagttcggcaacaatggttgaaacagggttgccaatcgcgcggaaacgctcagtgtcttcaacgtggatttgtgctctgtgagtaacatccagaccggccatcaccaccgggatccctgactggaagacaatttctgccgcttccgggtcaacgtaaatattaaattcagccgcaggcgtccagttacccagccccattgcgccgcccataatcacgatacgggcaattttgctatgcagttccggatggctattgagcagcaaggcaacgttagtttgcggtccggtagacacaatcgtgataggttccgcactttcacgcagcgttttcgccattagctctaccgccgtacagttttgcggtgcgaacgccggttccggtaatgccgggccgtcgagaccgctttcgccgtgcacattgtccgcgataatcaactcacgcattaacggttttaccgcgccgcctgctaccggaatatcggtgcgattaagcaaggtcagcatacgcagaacattgcgtaaggttttttctggtgtctggtttccggcggaagacgtaattgctttgacatcaagctctggtgaggcgagggcgagaactattgcgatagcgtcgtcatgacctgggtcgcaatctaacagaattggcagtgccattgttgctccttgttgtgtgcttctttgcgacaagggtaacgccaggatgtaacagatacgaggggcgaaacgataaagcgtgagatggcgcgcaattgggtatgcgcgccagagtgattaatgcaggattttcgcgaggaaatcttttgcgcggtccgatttcggatcatcgaagaaagcgtctttcggcgagtcttcgacaattttaccctcgtccataaagatcacccgattcgccactttacgggcaaagcccatttcgtgggtcaccaccatcatggtcattccttcgttcgccagttcgaccattacgtccagcacttcgttgatcatctccggatccagcgccgatgtcggttcgtcgaacagcatggcaataggatccatacacaatgcgcgagcgatcgccacacgctgctgctggccgccggaaagctgcgccggaaatttattggcatgtgcggaaagtcccacgcgctccagcaatttcaatgctttttcacgagccggtgctttatcgcgtttaagcactttcacctgcgccagggtcaggttttcgataatcgacagatgagggaacagctcgaaatgttggaataccatcccgacgcgggaacgcagctttgccagatcggttttcttgtcattaaccacgataccatcgacggtgatttcaccttgctgcactggttcgaggccgttgacggttttaatcagcgttgatttgccggaaccagacgggccgcaaaccaccaccacttcgccttttttcacttcggttgagcagtcggtcagcacctgaaagtgaccataccattttgaaacatttttcagggtaatcattatgctgtccttcttttcaagtagctgaccaacaacgacgcgctaagactaataacgaaataaacaaatccggcaaacaggatcatctcaacctgcgtaccatcacgctcaccaatggttgaggcggtacggaagaaatcggccagagataacacatacaccagcgaggtatcctggaacagtacgatgccctgagtgagcagcagcggcaccatcgcgcggaacgcctgcggcagaataatcagtttcatcgactgccagtgagtcattcccaacgccagcgcggcgctcgactgaccacgagaaatactttgaataccggcacggataatctctgaatagtaggccgcttcaaacatcgaaaacgccaccatcgccgaaattaaacgaatatcattttttggcgataatcccagcacattttgcagaaatcccggcacaatcaagtaaaaccacagcaaaaccatgactaaaggaatcgagcggaatacgttaacgtaggctttggcaaaccacgaaacaggcgcgaagctggacaagcgcatcaccgccagcatggtaccccacaaaataccaatcacgactgccgtgacggtgattttcagggtgatcaccagcccgtcgagcagatatggcagggaaggaacaatggaactccagtcaaactcgtacattatttgccccccatgttgccgggcaggcgaactttacgttcaaccagcgtcatcaccagcatgataaaagcgttaatcaacacatacgcaagcgtaatggcggtaaacgactcccaggcgtgggccgagtagtcgagcaatttacccgcctgcgctgccatatccaccagaccgatagtcgaggcgatggcggagtttttcaccaggttcatcatctcggaagtcattggcgggacgataacgcgatacgcgttaggcaacagcacgtagcggtaagcctgcggtagcgtcagacccatcgccagcgcggcattcttctgcccacgcggcagcgactgaatagcggcgcgtacctgttcgcaaacacgggcggcggtaaacagccccaggcagagcatggatgaaaggaaaaactgaatattgggatccagctcggccttaaaccacatgccgattttctccggcagcagctccgggatcaccagataccaggtaaagaattgcacaatcaacggcacgttgcggaacagttcgacatacaacgtacccagaccggagagaaaacggtttggaacggtacgtaaaatgccgaaaaatgaaccgacgaggaaagcgataatccaggcgcagatcgacaaagcgatcgtcacctgaaaaccactccagatccaaccaagataggtggtgttgccgaacggggcttgttgtaaaaaaataccccagttccagtctatagacataaatctactccagaaaaaagagggtagcagcgttaactgctaccctcgaagattgttacccagcgtattgcggttttcaggcccgatggggaacgaccatcaggcgtatagtctgtccgtgctacgtaacaatcgagagggctagaatttccgcccctggttcttgtaattagttcagtgctttgtcattcggttctttgaacagtgctttcatttcgtctgacagttcgaaattcatgttcaggtttttcggcggaattggatttttgaaccatttatcaaaccatttttccgcttcaccggaagtctgcacctgagcgatagtgtcatccatcagctttttgaactgcggatcatctttacgcaacatgcaaccgtaggcttcctgagactgcggcttgccgacgatatcccagttgtctggtttcttcgctttcgcacgttcaccggccagcagagcgtcatccatcataaaggcaacggcacgaccgctttccagggtacggaaagagtcaccgtgatctttggcgctaatgatgcgcatattcattttttgctcttcattcagtttgttgagcaaaacttcagaagtagtgccggaagtgacgactacggctttgcctttcaggtcggcaaaatctttgatatcgccgccctttttggtcagcaggcgcgtaccgaccacgaaaatagtatcagagaaagccgcctgtttttggcgttcgacgttgttggtggtagaaccacattcaaaatcgaaagtgccgttttgcagcagtggaatacggttttgtgaggtaatcggaatcagttttacctgcaagtccggtttgttgagtttctttttcactgcttcaacaatggcgttggagtaatcctgcgagtaacccaccactttttgctgattgtcgtaataagagaaaggtactgaagattcacggtgaccgacgacaatcacgccgtttttggcgattttgtccagcgtactgcccgctaccggggcggcgtcatctgcctgtgccagtcctgcggaaagcgccagggcgaggattgctgtggcaggtttacgtaattgcatatccaactcctttatcttctgcgttaagaacgcatggatacccgttgtgagtgtttgtgttgttatcgtctgcaactttattgtgcagtgttgtgcctgttaggtaacatttagtttggctaaatgtaaagatattgctgttttattgtttgtttttgcgagatgcgccgcaccattccgaagcaaaattcttaaaccgcacctttttggtgctaccgctgatttgtggtggtgcaacccggttgcgtcgcggttgatttcattgcttacacagtaaataaagcaacttacatgccaaaaaatacttagaagtgaattaattacgattgtaatttcaggctgaaaaagtcatatttcggacagggttaacttttcggtatgggacgtttgccgggatgataactgcacacgggaaaattgctttttacctgtcttttcaaggaagaatcatcttatgtctgcatcttcggttaagccgttaaatgttcaattacccgcaataacccttatcctttttgcgctctgtgttgggatattttgttacctcgcacaatggatgagttatgaagaagtcgatcaatccgcacttatccatctcggcgctaacgttgcttctctcacgttgtcgggtgaaccctggcgtttattgagcagtgtctttctgcacagcagtgtttctcatctgctgatgaatatgtttgcattcctggtggtgggggcagtggcggaacggatactggggaaatggcgactcctgattatctggttattctccggcgtctttggtgggctcatcagcgcctgttatgcgttacgcgatagtgagcagatagtcatcagcgttggggcatccggagcaattatgggaatagctggcgctgcgatagcaacacagcttgcttcaggtacgggcacgcaccataaaaatcagcggcgagtattttctctgttagggatggtggcgctgacactgttgtatggtgcccggcaaacaggaatagataatgcttgtcacattggcggcctgattgcgggtggcgcgttgggttggctgagtgcgcgtttatctgggcaaaaccggcttgttacggaaggcgggattattgttgcgggcagtcttcttcttaccggggctatctggcttgcgcagcagcagattgatgaatcagttttacaggtcaggcaaagcctgcgtgaagcgttttatccgcaggagattgaacaagagcgacgacaaaaaagcaacagttagcggaggaacgcaacgccctcaaagaaacattacccgctccggtaagtcgtcaacaggccagtggtgatttgctcgctgagattgccgatatccatgatatggcgatcagtcgggatggtaatacgttatatgccgctattgaaaacacaaacagcattgttgtgttcgacctcggacaaaagaaaatcctgcatacctttacagcgcccatagcgaaagaaaagtcagtcaaacattgtggtggctggaaagatcagggcgtcagatcgctggcgttaagcccggatgaaaagttgctttatgcgacttcatttgaagcgaatgcgttatcggtcattaacgtggcgacgggggagattattcagtcgattaccaccggtgcacatcctgacagccttatactctcgcgtgatggcaaaaaagcctgggtgatgaatcgcaccagtaatagtgtgtcagcgattgatctggtgacttatcagcatgtggcggatatcccgctggagaaatacgacgggacggggacgagcggtaaacctggtgcctgggttatggcactttccccggatgaaaaaacattgttgatacccggtatggtcagaggtgacattgtacgcatcaataccatcacgcatcagaaagaagactttcccgcaggtgatgcgcgtggaacgatatcggcgatgcgttttcgacctgaaaacggggatgtaatttttgccgacagtcaggggatttcacgtataagagttggggatcagcaagccagcattatgacgcaatggtgtagcaggagcgtttattccgttgagggtattagcccggacggtcagtatttagcgttggtgtcatatggcttgcaaggttatgtcatcctgctcaatattaatgtcgggcagattgttggcgtttatcctgccagctacgttaatcaccttcgtttttcggcggatggtagaaagatatttgttatggcgaagaacgggttaatccaaatggacaggacgctctcgcttgatccgcaggcagttattcgtcatccccaatatggcaatgtggcttgtatccctgaaccgtaagaaaaaggggcatgataatcatgccccacagcgtgttgagaaagtacgctttatcctacaaaatcacgtaaattcaacatattgcaaaaatcgcgtaggcctgataagcgtagcgcatcaggcacatcaacgtttacgtgctcgcagactcatcagcacagcggcaaaaccaaacagcgccgtcagcacccacagcggccagttgccggttcgtgcgtacggtgtgagtccggtcgtcggcgtcacgttagtggtcaacacctcgcgggtgaactgcgggatcatcgcctgaatctcaccctgcgggccaatcaccgccgtaatgccgttgttggtgctacgcagcaatgggcgcgccagctccagcgcacgcattcgcgccatctggaagtgctgccatggaccaatagacttaccaaaccatgcatcgttggagatagtcagcaggtagtcggtatccgggcggaagttatcgcgcacttgctcgccgagaatgatctcgtagcaaatagccgcagtaagctcaataccatttaccgacagcggcggctggatatatggcccacggctgaacgacgacatcggcagatcaaagaacggtgctaacggacgcagaatcgactccagcgggacaaactcgccaaacggcaccagatggtttttgttatagcgatcggctgattcgtagctgtacggtgcacctttacccagcgtgatgatggtgttgtaggtatcgtagcggttctgcttattgagacgcgcgtcgacaatcccggtgaccagcgagctacctttatcacgcaactcaccgtccagtgctttgaggaacggttgctgattaatttccagatcggttatcgccgactccggccagataatcaacgatgatttgcccatcagcggtgccgttgcgttgtagtaaatcttcagcgtattaagaagctggccttcgtcccatttcagcgattgtgggatatcgccctgaaccatcgaaacctgaatggttttctccggttgcggggtaaaccattggatgtaacgcagcgggaagggtagggcaaacagcacgacggccaccaccagcggacgccagttgcgtttgaccaacgccagtgccagcaggccactaaccatcatcagcaggaagttaatggcttccacgcccattatcggtgccagcccttttaacgggccatcaatctggctatagccgaactgtaaccacgggaagccggtcagtacccaaccgcgcagaaactcggtcacttgccagagggcaggggcagcaatcgccacgcgcagccaggtggttttcggccacagacgcgacagcacgccagcaaacagtccggtatacagcgacaaatacgccgccagcagcaccaccaggaagatgttaaccgggccaggcatcccgccaaaggtcgcgatgctgacatagacccagttaataccgctgccaaagaggccaaatccccagcaaaagccaatagcggcagactggagtgggcgacggttaaaggtcaacgcctgaagccccatcagcgaaataatcgccgcaggccagacgtcgtaaggagagaaggccagcgttccgcaggcaccgaataataacgccagcagcaggcgaatgcgctggcgttcaattaatgaggcaaaagccatgtagttatctatccagtttcggttttattcatccagctttggctggggtgagtcatccgggattttgacatgaacctgaataatacgccgactatcggccatcgccactttgaactggtaaccgtcgatgtcgatagtttcgccacgcgccggaagatgcccaaacgcctgcatcaccagaccaccgatagtgtcgacttcttcatcgctaaagtgggtgccgaacgcttcgttgaagtcttcaatggaagccagtgcgcgcacggtccaggtatgacgactcagctgacggaagtcgatatcatcttcttcgtcatactcgtcttcaatctcaccaacaatcagttccaggatgtcttcaatggtcaccagaccggaaaccccaccgaattcgtcaataacgatcgccatgtggtaacgctgagagcgaaactctttcagcatccggtctacgcgcttactttcaggaacgacaaccgcctgacgtaacactttgtccatgctgaaggcttcagcatcgctgcgcataaacggcagcaagtctttcgccatcagaatcccttcaatgtgatctttgtcttcgctaatcaccgggaaacgtgagtgggcggactcgatgatgacatcaaggcattcgtccagcgtctggttgcgtttcagggtaatcatctgggagcgggggatcatgatgtcgcgaacgcgttggtctgcgatgtccatcaccccttcgagcatatcgcgcgtatcttcgtcgataaggtcgttctgcccggaatcacggatcagcgccagcagttcgtcacggtttttcggttcaccgtggaaaagttggctgagtaacagggagaaaaatcccttcttgttgcttatcgtgtcactactgtgtgaattgtcgtcgctcatggcgtcgtatgggttctcatgttagttaatcaaaacgccgtcgttaatcaccaacggcggggacgtctgccagtcaaatgcctggcaaattattctttctcggcaatgtacggatcctcatagcccagagcaagcataatctctgtttcgagggcttccatttcttctgcttcgtcatcttcgatgtgatcgtaacctaacaaatgcagactgccgtgcaccaccatatgcgcccagtgcgcctccagtggtttgccttgctcctgagcttccttctcaaccacctgacggcagataaccagatcgcccagtagcgacatctccatgccaggcggcacttcaaacgggaaggagagcacgttggtcggcttatccttaccgcgataggtcagattcagactgtggctttcggcggtatcgaccacgcgaatagtcacttccgactcttcctgaaactgcgggatcaccgcattcagccatgtctgaaactggctctcttccggtaacccggaattatcttcacatgccagttgtaaatcgaggatcacctgactcatttttgttcctgttcttcgcgcttgcgttctgccgccagcgccgctttacgtttttgttcggcttcttcccaggcttcataggcgttaacgatacgcgccaccaccgggtgacgaaccacgtcttcgctgtggaagaagttaaagctgatctcttcgacatcggccagcacttcgatggcatgacgtaagcctgatttagtattacgcggcaggtcgatctgtgtgacgtcgccggtgataaccgcttttgagttaaaaccgatacgggtcaggaacatcttcatctgttcgatggtggtgttctggctctcatcgagaatgataaaggcgtcattcagcgtacgaccacgcatataggccagcggcgcgacttcaataacgttgcgctcaatcagtttctcgactttctcaaagcccagcatttcaaacagcgcgtcgtacagtgggcgcagatacgggtctactttctggcttaaatcgccaggcaggaagcccagtttctcaccggcttcgaccgccggacgagtcagcagaatacggcgaatttcctgacgctccagggcatcaactgctgcagcgactgccaggtaggttttacccgtacccgccgggccaacgccgaaggtaatgtcatggtcgagaatattggcgatgtactgcgcctggtttggcgtgcgcggcttaattacgccgcgtttggttttgatattgaccgctttgccgtactccggcacgctctccgcgctttgctccagtacccttgcttctttaatcgcaaggtggatctgttccggttcgatatcctgaatctgaccgcgcatcggggctgtatcgacatacaggctacgcagaatgtctgccgcagcggtgacgcaaatcggacggccggtcagtttaaagtggttgtcgcggcgattgatctcgatgccgagacggcgttcgagctgcttgatgttgtcatcaaacgggccgcacaggctcaacagacgcgcgttgtctgctggctccagggtgatttcgcgagtgtctatgttcaaaccgttcctcttatctgtatgccgccggaagctgaacattcaccggcctataaggaaattattcacgccacaggaaaaaggcgcaagcattgcgataaagatggggataaagagagaaaaaacaaggcccaccggaacggcgggcctgagaattacggctgataataacccacgccaaggtcgttttctttgcgggtacgggcaatcaccgattccggtgtttctgccacgcgcagacccatttcatcttcagtacgcaccactttaccgcgcagagagttcgggtagacgtcggtaatttctacatcgacgaatttaccgatcatatccggtgtgccctcgaagttgaccacgcggttattttcggtacgcccggaaagctccatgatgctcttacgcgaagtcccttctaccagaatacgctgggtggtgccgagcatccggcggctccatgccatcgcttgctgattgatacgttcttgcagaatatacagacgttgcttcttctcttcttccggaacatcatcaaccatatcggcggctggtgtacccggacgtgcagagaagataaagctgtagctcatgtcgaaattgacgtcggcaatcagcttcatcgttttctcgaagtcttcggtggtttcgccagggaagccaacgatgaaatcagaactgatctgaatatctggacgcgccgcacgcagtttacggatgatcgctttgtactccagtgccgtatgagtacggcccatcaggttcagaatgcgatcggaaccgctctgtaccggcagatgcaggaagctcaccagctccggcgtgtcgcggtacacttcgatgatatcgtcggtgaattcgatcggatggctggtggtaaagcgaatacgatcgatcccgtcgatcgcagcaaccagacgcaacagatcggcaaacgatccggtggtgccgtcgtagttttcaccacgccaggcgttcacgttctgaccgagcaggttgacttcacgcacgccctgagccgcaagctgggcaatctcaaacagaatatcgtcggacggacggcttacctcttcaccacgggtgtaaggcaccacgcagtaggtgcaatatttattgcagccttccatgatggagacaaacgcggtcggcccttcggcgcgcggttccggtagacggtcaaacttctcgatttccgggaagctgatatctacaaccgggctgcggtcgccacgcacggagttgatcatctccggcagacggtgcagcgtttgcggcccaaaaataatatcgacatagtgggcgcgctggcgaatgtgctcgccttcttgcgatgccacgcagccaccgacgccgataatcaggtctggattcttctcttttaacagtttccagcggcccaactgatggaagactttttcctgagccttctcgcggattgagcaggtgttcagcagcagcacatccgcttcttccgccacgtcggtcagttgatagccgtgggtggcatccagcagatcggccatcttcgatgaatcgtactcgttcatctgacagccccaggttttaatatggagttttttggtcatcgacttgctcttgcgaaatagtagccaggaatgcagggcgcatagtgtaatgctttgctgccgttgtgaccagtatgagcgttatcagcccttaggggtaaaaatcctgtaaacttaaagcatattgctaacaggatgattgaccatgacaaatcaaccaacggaaattgccattgtcggcggaggaatggtcggcggcgcactggcgctggggctggcacagcacggatttgcggtaacggtgatcgagcacgcagaaccagcgccgtttgtcgctgatagccaaccggacgtgcggatctcggcgatcagcgcggcttcggtatcattgcttaaagggttaggggtctgggatgcagtacaggctatgcgttgccatccttaccgcagactggaaacgtgggagtgggaaacggcgcatgtggtgtttgacgccgctgaacttaagctaccgctgcttggctatatggtggaaaacactgtcctgcaacaggcgttgtggcaggcgctggaagcgcatccgaaagtaacgttacgtgtgccaggctcgctgattgcgctgcatcgccatgatgatcttcaggagctggagctgaaaggcggtgaagtgattcgcgcgaagctggtgattggtgccgacggcgcaaattcgcaggtgcggcagatggcgggaattggcgttcatgcatggcagtatgcgcagtcgtgcatgttgattagcgtccagtgcgagaacgatcccggcgacagcacctggcagcaatttactccggacggaccgcgtgcgtttctgccgttgtttgataactgggcatcgctggtgtggtatgactctccggcgcgtattcgccagttgcagaatatgaatatggcacagctccaggcggaaatcgcgaagcatttcccgtcgcgtctgggttacgttacaccgcttgccgctggtgcgtttccgctgacgcgtcgccatgcgttgcagtacgtgcagccagggcttgcgctggtgggcgatgccgcgcataccatccatccgctggcggggcagggagtgaatcttggttatcgtgatgtcgatgccctgattgatgttctggtcaacgcccgcagctacggcgaagcgtgggccagttatcctgtcctcaagcgttaccagatgcggcgcatggcggataacttcattatgcaaagcggtatggatctgttttatgccggattcagcaataatctgccaccactgcgttttatgcgtaatctcgggttaatggcggcggagcgtgctggcgtgttgaaacgtcaggcgctgaaatatgcgttagggttgtagccttacaacattgccggatgcgtgccaaccgtaggtcggataagacgcggcagcgtcgcatccgacattgaaggataagacgtgtcaacatcgcattcgacattgaatgaacgcagaaaagcaaaaagctcgccgaagcgagcttttttaatgtggctggggtacgaggattcgaacctcggaatgccggaatcagaatccggtgccttaccgcttggcgataccccaactgggtgcacttacaaggtaagcgtcttgaataaattggctggggtacgaggattcgaacctcggaatgccggaatcagaatccggtgccttaccgcttggcgataccccaacaaattggttttgaatttgccgaacatattcgacacattcagaatttggtggctacgacgggattcgaacctgtgaccccatcattatgagtgatgtgctctaaccaactgagctacgtagccagattgtttcttcgatggctggggtacctggattcgaaccagggaatgccggtatcaaaaaccggtgccttaccgcttggcgataccccaataaccgggcggtgaaccgcttactcgaagaagatggctggggtacctggattcgaaccagggaatgccggtatcaaaaaccggtgccttaccgcttggcgataccccatccgtacaacgctttctggtgaatggtgcgggaggcgagacttgaactcgcacaccttgcggcgccagaacctaaatctggtgcgtctaccaatttcgccactcccgcaaaaaagatggtggctacgacgggattcgaacctgtgaccccatcattatgagtgatgtgctctaaccaactgagctacgtagccatcttttttttcgcgataccttatcggcgttgcggggcgcattatgcgtatagagccttgcagcgtcaacctctttttcaaggaaaattgctcgaaagtgactgtttggttaggttgcgaacagcgtggcgctatattcgtcaattattgtttactttgtgttttttccccaccctacagccattcttttgtcgtacaggatgaaattcggaattcaacaatagtggtgggaaattaatctatgaaatactggcctacagtgatgagttgtcaaacagtgatgtggcaaacccggaacatttccttactgcatatcagaatcaacaagcacctcaataactgaaacagccccggatttcaccggggctgtttcgcatttcttacttatatgccgactggtgaacaccaaccgcacgaccagatggatcgtccattttcttgaacgcttcatcccattcgatcgctttagcggaagaacacgcgacggaaggaccgccaggcacgcactcagcggcgctcggaagcgggaacagttcttcaaagatctcccggtacagatacgcttcttttgaggttggcgtgttgtacgggaagcggaagcgggcagtttccagttgctgatcagaaacctgctgcgccgccacttctttcagggtgtcgatccaactgtaaccgacgccatcggagaactgctctttctgccgccaggccacgcttgcgggcaggtatgactcaaaacattcacgcaggatgtgtttttccattttgccgttaccgcacattttatcctgcgggttaatgcgcatcgccacatcaaggaattttttgtcgaggaacggaacgcgtgcttccacgccccaggctgacatcgctttgttggcgcgcgcgcagtcatacatatgcagggccagcagtttacgcaccgtctcttcatgcagttctttagcgttgggcgctttatggaagtaaagataaccgccaaacacttcatcagaaccttcaccggacagcaccattttaatgcccatcgccttgatcttacgcgacattaaatacatcggtgttgaagcgcgaattgtggtcacatcataagtttcgatgtggtaaatcacgtcgcggatggcatccagaccttcctgtacagtgaagtgaatttcgtgatgcaccgtgcccagatggtttgccacttcctgggctgctttaagatccggtgaacccggcagacctacagcaaaggagtgtaactgcggccaccaggcttcagagcgttcctgatcttccacgcgacgggctgcgtatttcttggtgatagcggaaataattgaggaatccagaccaccagaaagcagcacaccgtaaggcacatcagacatcagatggcttttaacggaatcttcaagtgcctgacgcagctcgtttttgtcggttacgttatctttcaccgcatcgtagtcgaaccagtcgcgatgataataagaacggatttcgccgtcctggctccacaaatagctccccgccgggaactctttaatcgtgcggcaaactggcaccagggctttcatttctgaggccacatacagctgaccgtgttcgtcatagcccatatacagtgggatgatccccagatggtcgcgaccaatcaggtaggcatctttttcgctgtcgtacaaggcaaaggcaaacatgccctgcaagtcgtcgagaaattccggccctttttcctgatacagcgcgaggatcacttcacagtcagatccggtctggaactgataacgatcgccatattcggcgcgcagtgcctggtggttgtagatttcaccgtttaccgccagcacatgagttttttgttggttgtagagaggttgcgcccccgcgttaacgtcaacaattgacagacgttcgtgggcgagaatggcgttatcgctggcataaataccggaccagtccgggccacgatgacgcatcaggcgtgacagctcgagtgctttcttacgcagctcaactgcgtctgttttgatatcgaatacgccaaaaattgaacacataaccttctccgttaacctggtatttgttgcttgttgtgtttgcttgtttaaaaaaatgccgcaaagcagcactgtgcgcaagcgatttggcggtgaaaaaataaaaaacgtaatggtgattgtcgattggtgaaaaaaggtctggtgtaaggatgtatttattgatgaatcgataatttttagcgggttttattgaatggttatattttacgggggccaaattgctgacaaagtgcaatttgttcatgccggatgcggcgtgaacgccttatccggcctacaaaagcatgaaaattcaatatattgcaggagctgcgtagatactgttatggcctgcaagttttttcctggtccggtttcccggattgcaggcatgccagacacagcgccgtcaggcgctgtttttttcatcccttccgcgatttttacgccgctaccggattatgccgtgacgcatcgaacggcacgcctgacttcagcactccatacgccacctgtgccagcttgcgcatcatcgcgccgagaatcacctttcctttcttgccattagccgccagacggtcgcggaacgcccgtccccactcagtcttactggtggctaccattgcgggcatatacaacgccctgcgaagcgacacatgtccggccttactcatccggctcgcccctctcacactgctacctgattcataacgccgtggtgtcagacccgcaaaagcggcgaactgtctggcatgggcgaagcggtccttcagaccgatataagccagcaataccgcagatgttttctctccgatacccgggatgctttccagcagtttcctgcggtgtttcatatccggatcatcgtctgtcaggtcttttatctgcttctcaagacgcttcagctctgcttcaagccacagaaggtgagcatcaatgctcggtctctggacttcccgcgccgtttcagtgcgattcagttcctgcgtgtgcatatctgtcagcgcctggtggcggactaccagggcacgcaacgcgcgttcaagcgggtgaggcgcttcccaggctgcagggcgcttctgacgacagaactctgccagcatgcgcgcatccacggtatcagtcttgttacgcagtccttcactctgagcgaaagctttacccagcgcaggattaatgactgacactatgtagccagcatcgtaaaggcactcagcgacaggttccatataggtgccggtcgcttcgatgcagatatgcgcatggtcaatcttgtgacctttcagccagctcaccagctcatcgtgccctttagtggtgttagcgaattttttggtgcgatgacgaccatcaggacgcaacacatcgacatccagtttctctttagcggtgtcgataccgatataatgaagttcatgttccatagtgaaaccaaccttgcaaatacggattaccgggaaaaccggtccatgatactgtccggtttatcactttgggagaaaggcagtccgctgcataaatctacgcaacaggttagaacccaaggcccgatacggcatgcggactgcaggcagagaaaactggccgattttctctgcactggagggataatacaaggcctgataagcgtagcgcatcaggcaatgttgcgtttgtcatcagagccaaccacgtccgcagacgtggttgctattcagataacgtcgatttcagcgaccgacgggtaaatccagcttgggcggaacggcatactgtcgatatcgtcgagcgatgaaacaccagaaagcaccagaatcgtttccagacctgcctggaagcccgccagaatatcggtacgcaggttatcgccgacaatcaccgtttcttccgaatgcgcctgcattttgtttaatgccgcgcggatgatccacggactcggtttaccaacatagaacggtttacgcccggagattttttcgatgcctgcacacaacgcgccacacgcgggataaaaaccgcgcccgtgggtgtccggattggtggcgataaaacgtgcaccgttagcgacgaaataggctgctttatgcatcatgtcccagttgtaggaacgcgtttcgccaacaatcacgaaatcagggttcacatcggtaatagtgaaaccggctttgtacagttcatgaatcagtgcgccttcgcccaccacatacgctttcttgccttcctggcgacgcaggaaatcggcagtcgccatcgcagaggtataaaacacgctgtcaggtacatcgacacctgcggtggcaaagcggttcgccagatcttgcccagtctgcgaaggatagttggtcagcaacaccagcggcaggcctttatccataatcccgtgcaaaaattccgctgcacccggtacggcgacgttatcgtgcatcagcacgccgtcgatatcgcaaattacatttttaatggtcatggactacccagaatattgacaacaataagcgccactataaaagcacattaattttccagcaaatgctggagcaaaataccgttgagcatggcgcgttttaccagcgcaaaagcgccgattgccgagcggtgatccagctcagaacgtaccaccggcagattagtacgaaacgccttcagcgcctgggtattaatgcagctttcaatagcagggagcagcactttatcggcttcggtgatttctccggcaataacaattttttgcgggttaaacaggttgatggcaatggcgatggttttgcccagatgacgaccaacatactcaatcacttccgacgccaggctatcgcctttgttcgcagctttgcagatagttttgatggtacagtcgtccagcggcacgcggctctggtagccctgctttaacagattcaacacccgttgttcaatggcagcgttggcggcgatagtttccaggcagccaaagttgccgcagtggcagcgttcacccagcggttcgacctgaatatggccaatttcaccgacgttgccgttgcggccaataaaaatgcgcccgttagagatgattccggccccggttccgcgatggacacgcactaaaatggagtcttcgcaatcctgacttgcaccgaagtagtgctctgccagcgccagactacggatatcgtgaccaacgaaacaggtcactttaaaacgctcttccagtgcttctaccagcccccagttttccacctgaatatgcggcatgtaatgaattttgccgctgtccgggtcaacaagtccaggcaggatcacggaaatggcgatcagctcgcgcagcttgcgttggtagctatcaataaactgagcaatggcattcagcagggcatgttccagcgtctgctgggtacgttccggcagcgggtaatgttcttctgccagcactttgctgctgagatcaaacagagtaatggtggcgtcgtgacgaccaagccgtacaccgattgcgtggaaattgcgggtttcggtgacgatagagatagcgcggcggcccccggtggaggcctgctgatcaacttctttgatcagcccgcgttcgataagctgacgcgtaattttggttacgctggcgggggcaagctggctttgctcggcaatctgaatccgcgagattggcccgtactggtcaatcaggcgataaaccgccgcgctgttaagctgttttacgagatcaacattacctatctgagcttgtccgcctggtgtcatactttctcttattgagttacgacctcgttaccgttaacgatggtcttggtgattttaaaatcaggtgtgaatgcggtcaggttggctactttacctgcggcgagtgtgccgagacgtttctcaacgccaatcgcacgcgccggatagagcgtcgccatacgcagcacttcatccagtgcgataccgcaatgttcgaccagattacgcacgccttcaatcatggttaaggatgaaccgcttaacgtaccgttctcatccacacaaagtccgttacggtagtatattgttttacccgcaaaaatgaactgttcaatgttggcacctgctggcgcggtggcgtcggtaaccagacacagtttgtcgcctttcaggcgtttagcgttacgaatgttggcgtaatcaacatgcaggccatcagcgataataccgcaataaatgtcagcttcgtcgaggatcgcgcccgccaggcccggttcacgaccggtaatatacggcatcgcgttgtacagatgggtggcaaaggtaatccccacgcggaaaccggctttcgcttctttcaacgtcgcgttggagtgaccggcagaaaccacaatcccggcatttgccagtttgctgatgacttctgcaggaaccatttccggtgccagggtcactttagtaatgacgtcggcgttcttacacaggaaatcgaccagcgcggcatcaggcttacgcacaaaattcggattatgggtgcctttttttaccagattcagccacggaccttccagatgcagacctaacgcctgattcggatgttttgccaggtactcgcgcataacgcgcacgccctgtttcatcagctcatcgctggtggtgataagcgtcggcagatagttagtacagcctgatttctcattggctttctgcatgatttccagcgtttccacgctgaccgcttcagcggtgtcgttaaactgtacgccgccgcagccgtttaactgcacatcgataaaaccgggggagagaatggccccgttcagtgaacgttgttcgatctctggcggcagttccgctaccggacagacgcttttaatcaggccatcagcgataacaaccgcgtggtcatcaagaaattcgtggccggtaaagatccggccctgggttaatgcatacattctgacccccgattataaaaaatattgccctgagcaaggagccagggcagggataacaattacagacctttgatattttctgcttctaattcattgaaatatcttaaagtcttaactttcagctccatggtggaaggttcatcgcataccatgatcgcttttggatgcagttgcagacagctgatggtccacatgtggttcacgcaaccttcaacggcggcctgcagtgccagtgctttctggctacccagcaccagaatcatcacttcttcggcatccagcaatgtaccaacaccgacagtcagggcatattttggcacctgattgacatcgttatcaaagaaacgagagttcgcgacgcgagtgtcatgagtcagggttttgatacgagtacgagaagccagagaagacgccggttcgttaaatgcaatatgaccgtcgttacctacaccgcccataaacagatgaatttttccgtaagaacggattttttcttcatactggcggcactcggcgtcgatatccggggcgttgccgttgagaaggttgatgttttctgctggaatatcaacgtgatcgaagaaattacggtgcataaagctgtagtagctttccggatgctctttcggcagaccgacatattcgtccatgttgaaggtgacaacgtgcttaaagctgacctggcctgctttatgcatttcgactaacgctttataggtggtcattggcgtgccgccagttggcaggcccagaacaaacggacgatcggcagtcggtttgaacgcattgatacgattgacgatatggcgagcagcccatttaccgacctgttcagcggtagtcagggggatcagtctcattattcacctcaataagtaaaatgtaagccgttggcggattaggcatctttaagcgtaacctggatttgcgcagacaggcgtcaatccgacctgattttttgaatggtaaaataagttttctggtttagccagtaaaagggagtgatgataacgatatttggtgacaaaactcacaaaagacacgcgtttaatttgcgatacgaattaaattttcacacactctgtagcagatgatctaacaatctgattacagaacatcggcagtacaatttgcagcaaaataaaaatacggctttaaacgagccaaatagggttctcgtagggggaataagatgaatattttaggttttttccagcgactcggtagggcgttacagctccctatcgcggtgctgccggtggcggcactgttgctgcgattcggtcagccagatttacttaacgttgcgtttattgcccaggcgggcggtgcgatttttgataacctcgcattaatcttcgccatcggtgtggcatccagctggtcgaaagacagcgcaggtgcggcggcgctggcgggtgcggtaggttactttgtgttaaccaaagcgatggtgaccatcaacccagaaataaacatgggtgtactggcgggtatcattaccggtctggttggtggcgcagcctataaccgttggtccgatattaaactgccggacttcctgagcttcttcggcggcaaacgctttgtgccgattgccaccggcttcttctgcctggtgctggcggccatttttggttacgtctggccgccggtacagcacgctatccatgcaggaggcgagtggatcgtttctgcgggcgcgctgggttccggtatctttggtttcatcaaccgtctgctgatcccaaccggtctgcatcaggtgctgaacaccatcgcctggttccagattggtgaattcaccaacgcggcgggtacggttttccacggtgatatcaaccgcttctatgccggtgacggcaccgcggggatgttcatgtccggcttcttcccgattatgatgttcggtctgccgggtgcggcgctggcgatgtacttcgcagcaccgaaagagcgtcgtccgatggttggcgggatgctgctttctgttgctgttactgcgttcctgaccggtgtgactgagccgctggaattcctgttcatgttccttgcaccgctgctgtacctcctgcacgcactgctgaccggtatcagcctgtttgtggcaacactgctgggtatccatgctggcttctctttctctgcgggggctatcgactacgcgttgatgtataacctgccggccgccagccagaacgtctggatgctgctggtgatgggtgttgtcttcttcgctatctacttcgtggtgttcagtttggttatccgcatgttcaacctgaaaacgccgggtcgtgaagataaagaagacgagatcgttactgaagaagccaacagcaacactgaagaaggcctcaatcaactggcgaccaactatattgctgcggttggcggcactgacaacctgaaagcaattgacgcctgtatcacccgtctgcgccttacagtggctgactctgcccgcgttaacgatacgatgtgtaaacgtctgggtgcttctggtgtagtaaaactgaacaaacagactattcaggtgattgttggcgcgaaagcagaatccatcggcgatgcgatgaagaaagtcgttgcccgcggtccggtagcagctgcgtcagctgaagcaactccggcaactgccgcgcctgtagcaaaaccgcaggctgtaccaaacgcggtatctatcgcggagctggtatcgccgattaccggtgatgtcgtggcactggatcaggttcctgacgaagcattcgccagcaaagcggtgggtgacggtgtggcggtgaaaccgacagataaaatcgtcgtatcaccagccgcagggacaatcgtgaaaatcttcaacaccaaccacgcgttctgcctggaaaccgaaaaaggcgcggagatcgtcgtccatatgggtatcgacaccgtagcgctggaaggtaaaggctttaaacgtctggtggaagagggtgcgcaggtaagcgcagggcaaccgattctggaaatggatctggattacctgaacgctaacgcccgctcgatgattagcccggtggtttgcagcaatatcgacgatttcagtggcttgatcattaaagctcagggccatgttgtggcgggtcaaacaccgctgtatgaaatcaaaaagtaatctgctttatgcctgatgcgacgcttgacgcgtcttatcaggcctacaaaagctcagtccaggttggataagacgcttaagcgtcgcatccaacaatgacgcaggactggcaaaagcggtggagatcttctctgccgctttttttttcatcaatcatccccataatctcagtgagattttcgattttcactaactaacagttgtcagcctgtcccgcttataagatcatacgccgttatacgttgtttacgctttgaggaatccacgatgagtgaggcagaagcccgcccgactaactttatccgtcagatcatcgatgaagatctggccagtggtaagcacaccacagtacacacccgtttcccgccggagccgaatggctatctgcatattggccatgcgaaatctatctgcctgaacttcgggatcgcccaggactataaaggccagtgcaacctgcgtttcgacgacactaacccggtaaaagaagatatcgagtatgttgagtcgatcaaaaacgacgtagagtggttaggttttcactggtctggtaacgtccgttactcctccgattattttgatcagctccacgcctatgcgatcgaactgatcaataaaggcctggcgtacgttgatgaactgacgccggaacagatccgcgaataccgcggcaccctgacgcaaccgggtaaaaacagcccgtaccgcgaccgcagcgttgaagagaacctggcgctgttcgaaaaaatgcgtgccggtggttttgaagaaggtaaagcctgcctgcgtgcgaaaatcgacatggcttcaccgtttatcgtgatgcgcgatccggtgctgtaccgtattaaatttgctgaacaccaccagactggcaacaagtggtgcatctacccgatgtacgacttcacccactgcatcagcgatgccctggaaggtattacgcactctctgtgtacgcttgagttccaggacaaccgtcgtctgtacgactgggtactggacaacatcacgattcctgttcacccgcgccagtatgagttctcgcgcctgaatctggaatacaccgtgatgtccaagcgtaagttgaacctgctggtgaccgacaagcacgttgaaggctgggatgacccgcgtatgccgaccatttccggtctgcgtcgtcgtggttacactgcggcttctattcgtgagttctgcaaacgcatcggcgtgaccaagcaggacaacaccattgagatggcgtcgctggaatcctgcatccgtgaagatctcaacgaaaatgcgccgcgcgcaatggcggttatcgatccggtgaaactggttatcgaaaactatcagggcgaaggcgaaatggttaccatgccgaaccatccgaacaaaccggaaatgggcagccgtcaggtgccgtttagcggtgagatttggattgatcgcgccgatttccgcgaagaagctaacaagcagtacaaacgtctggtgctgggtaaagaagtgcgtctgcgtaatgcttatgtgattaaggcagaacgcgtcgagaaagatgccgaaggtaatatcaccaccatcttctgtacttatgacgccgataccttaagcaaagatccggcagatggtcgtaaagtcaaaggtgttattcactgggtgagcgcggcacatgcgctgccggttgaaatccgtttgtatgaccgtctgttcagcgtgcctaacccaggtgctgcggatgatttcctgtcggtgattaacccggaatcgctggtgatcaaacagggctttgctgaaccgtcgctgaaagatgcggttgcgggtaaagcattccagtttgagcgtgaaggttacttctgcctcgatagccgccattctacggcggaaaaaccggtatttaaccgcaccgttgggctgcgtgatacctgggcgaaagtaggcgagtaattttaagtttcgctatgccggatggggcgtttacgtcgcatccggcaaggaacagacaaacagtttcaaacgctaaattgcctgatgcgctacgcttatcaggcctacatgatctctgcaatatattgagtttgcgtgcttttgtaggccggataaggcgttcacgccgcatccggcaagaaacagcaaacaatccaaaacgccgcgttcagcggcgttttttctgcttttcttcgcgaattaattccgcttcgcaatttatccataaaataaatttaaaataacaaaacataattaaataaaatgtaaccgctttcatcttgctggaatttcacgcttttattcttctgcaagcctttcaaccgcaaacttaagccttgtaacaaaaatcatcaaaatatgtgcggttgctcatgttcttacattctggttacagaaagagattgataattcgcgtcgcgaaaaatagtctgttcctgtagtcagcgagacttttctcaacgctacttttttaatttttattttttcgctgttcacctttggtgcagcaatttatacgtcaaagaggattaacccatgcgtacgtttagtggcaaacgtagtacgctggcgctggctatcgccggtgttacagcaatgtcgggctttatggcaatgccggaggctcgcgccgaaggattcatcgacgattcaaccttaaccggcggtatatattactggcagcgtgaacgcgaccgtaaagatgttaccgacggcgacaaatacaaaaccaacctttctcactccacctggaatgccaacctcgattttcagtctggttatgctgctgatatgttcggccttgatattgccgcgtttacggcgattgaaatggcggaaaacggcgacagctctcacccgaacgaaatcgcgttttcaaaaagtaataaagcctatgacgaagactggtccggcgacaaaagcggtataagcctgtataaagcagcggccaaatttaaatacggtccggtttgggcgagggcaggttatattcagccaaccggtcagacgctgttagcgcctcactggagctttatgccgggtacttatcagggtgcggaagccggagcgaattttgattacggcgatgccggtgcgttgagtttctcctacatgtggaccaacgaatacaaagcgccgtggcatctggaaatggatgagttttatcagaacgataaaaccaccaaagttgattatctgcactcccttggggcgaaatacgacttcaaaaataacttcgtactggaagcggcttttggtcaggcggaagggtatatcgatcaatattttgccaaagccagctacaaatttgatatcgccggtagcccgttaaccaccagctaccagttctacggtacccgcgataaagttgacgatcgcagcgtcaacgacctttatgacggcaccgcctggctgcaggcgttgacctttggttaccgggcggctgacgtagtggatttgcgcctcgaaggcacctgggttaaggctgacggtcagcagggatacttcctgcaacgtatgactccaacctacgcttcctcaaacggtcgcctggatatctggtgggacaaccgttctgacttcaacgccaacggcgaaaaagcagtcttcttcggtgcgatgtatgacctgaaaaactggaatcttccaggcttcgccatcggcgcttcctacgtttacgcatgggatgctaaacctgcgacctggcagagcaatccggatgcgtactacgacaaaaaccggactattgaagagtctgcatacagcctggatgcggtctataccattcaggacggtcgcgccaaaggcacgatgttcaaactgcacttcaccgaatacgacaaccactccgacatcccaagctggggcggtggttacggcaacatcttccaggatgagcgtgacgtaaaatttatggtaatcgcaccattcaccatcttctgatgcccgacgcggcaggttttgtgcctgccgcacgtttgaggaatttgctatgaaaaaactgattctcatcgccatgatggcatcggggctggtagcttgtgcgcaatcaaccgcaccacaggaagacagctgtctgaaagaggcatacagcgcctgtatcaacaccgcgcaaggttcgccggaaaaaattgaagcctgccagagcgtgttaaacgtgctgaagaaagagaaacaacatcagcagtttgccgaccaggaaagtgtccgcgtactggattatcagcagtgtctgcgtgcaacgcaaaccggaaatgatcaggcggtgaaagccgattgtgataaggtctggcaggaaattcgcagtaataacaaataagtgagagctgtaactctcgcttttcttatttcccttgcataaaaaagccaacccgcaggttggcttttctcgttcaggctggcttatttgccttcgtgcgcgtgctcatcttcgcggcaatcgccttcggcacagtgaccgtaaagatagagactgtggttagtcaggcgaatgccatgttttgcggcaatttcacgctgacgcgcttcgatggaatcatcactaaattcgataaccttgccgcagtcgaggcagatcaggtgatcgtggtgatgttgctgtgtcagttcaaatacggatttaccgccttcaaaattgtggcgggtgacgataccagcgtcgtcaaactggttcagtacgcgatataccgtagccagaccaatttcttcacccatatcgatcagacgtttgtataaatcttccgcactgacgtgatggttgtccggctcctgaagaacttccaggatttttaaacgaggaagcgttactttcaggccagctttctttagggcggtattgttatcagtcatgcggaatctgtcctgttactaagcggttcacttcattagaagaagtgacagaatttgctcttgagataatgcgtatcattatagaattgccacgcctaaatgaaaaccacaagtccctggcaaatattgttaataaaaacgtggcatagcttacatttacaacggcaaggccacttgaacaccgggacattgtacaggtacaacagcaaaagttacaaatttgtagcaattattttgattggcattatctattaatacggcgtagacatgagtctacgccgcatcacatcaggcattgagaatttcgtcgagatgcaactcttcagaaatctgtttaacccatttttctacacgttcagcggtcagttccggctgacggtcttcgtcgatagccagaccgacaaagtggtcgtcatctgccagaccttttgatgcttcgaaatgatagcccgcagttggccagtgaccaacgatggttgcaccgcgcggttcaatgatgtcgcggatggtgcccaatgcgtcgcagaaatattcggcgtaatcttcctggtcaccacaaccaaacagcgcaaccagtttgccattgaaatcaatctcttcgagagtcgggaagaagtcatcccagtcacactgcgcttcgccgtaataccaggttgggatgcccagcagcagaatgtcataagcttccagatcttctttgctgctttttgcaatgtcatggacatcggcaacgtctttaccaagctgtttttgaatcatttttgcgatattttcggtattaccggtgtcgctgccgaaaaagatgccagtgatagccatgagtgaaataacctcttgaaacttattgaaatgggggtggaaaattgcccacggataaaggcaatcatagcagaacaggcagtcttgcggaatcagcaaacgagcaggactgcacactgtgctacatgaaagtggaaatttaaacgatgccctgactacgcagcgccgccagttgctgcattaacatctcttcgatcagttcgctacggctcatattgcgcgattccgccagctcgttcagcgcctcgacagcttccgcgttcagcttcagttcgacacgcttaaggccacgtactttgtcgcgttttagttggttgcgtttattaatacgcagctgttcatcgcgcgaaagcggattagttttcggtcgtcccggtcgacgctcgtgcgcgaacagatctaatgtcgtacggtccgtttgttctttggccatgatcttggtgacttcgggggaaacaatcagccaggcctctgcccggatggatagcgcgccataatacatcagcgcgatgagtcacgccaacgcccacgcgcggaaagcgacgcggacgctgggtttttaatcagttgcgttaatcattgagatagcgacggatagcgcgtaataccgcatctggtttttcagcatggacccagtgacccgcgcctgcaatcacatgcgcccgtgcctgtggaaattgtgccagtaaatcatcacggtactgctcgctaacatacggagaattaccaccagggataaacagggcagggtgatcccatgccgggattttctcccaacccacaatatgcggatactgatcccacaataccggcacgttaaagcgccactccccgtcaacaaaagatttcaacagaaactgaatcaccccttcttcattaagatgctggcgcattattgctgctgcttgctggcgagtttgtgcgtccgattcactgaccgcgttgatagctgcgaaaatctcatcatgacggcgtacgtgatagtcgaccggtgcgatatcgatcgccaccagtttatcgatgcgatcgggggccagtgcagtaagtgccattaccgctttaccgcccatggagtgaccgataaatgttgctttgtcgatctgcagtgcatccagggtatcaacaagatcctgcgccatcgccgggtaattcattaccggctctctcggtgaaagaccgtggttacgcatatcaacctggatgatattgtgatcgtttaccagatcgcgagccagtacgccaaggttgtcgaggctaccaaacagaccatggacaagaacgatgggagaattattgtgctggttttgtgcagtttgcgcgcggatattcaatttcatggcaaagttctttttttcgcgttgtcgggttagggtattatgttgaccattgtgccacagggctgcaacaaataaggtttattccgagtttttctgcaagccaggcttgacgctatccgctgccgggatttattcatatactcctggcgacttgtattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggacgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaaaacgttgcagacaaaggacaaagcaatggcaatccacaatcgtgcaggccaacctgcacaacagagtgatttgattaacgtcgcccaactgacggcgcaatattatgtactgaaaccagaagcagggaatgcggagcacgcggtgaaattcggtacttccggtcaccgtggcagtgcagcgcgccacagctttaacgagccgcacattctggcgatcgctcaggcaattgctgaagaacgtgcgaaaaacggcatcactggcccttgctatgtgggtaaagatactcacgccctgtccgagcctgcgttcatttccgtactggaagtgctggcagcgaacggcgttgatgtcattgtgcaggaaaacaatggcttcactccaacgcctgccgtttccaatgccatcctggttcacaataaaaaaggtggcccgctggcagacggtatcgtgattacaccgtcccataacccgccggaagatggtggtatcaagtacaatccgccaaatggtggcccggctgataccaacgtcaccaaagtggtggaagacagggccaacgcactgctggccgatggcctgaaaggcgtgaagcgtatctccctcgacgaagcgatggcatccggtcatgtgaaagagcaggatctggtgcagccgttcgtggaagggctggccgatatcgttgatatggcggcgattcagaaagcgggcctgacgcttggcgttgatccgctgggcggttccggtatcgaatactggaagcgtattggcgagtattacaacctcaacctgactatcgttaacgatcaggtcgatcaaaccttccgctttatgcaccttgataaagacggcgcgatccgtatggactgctcctccgagtgtgcgatggcgggcctgctggcactgcgtgataagttcgatctggcgtttgctaacgacccggattatgaccgtcacggtatcgtcactccggcaggtttgatgaatccgaaccactacctggcggtggcgatcaattacctgttccagcatcgtccgcagtggggcaaagatgttgccgttggtaaaacgctggtttcttctgcgatgatcgaccgtgtggtcaatgacttgggtcgtaagctggtagaagtcccggtaggtttcaaatggtttgttgatggtctgttcgacggcagcttcggctttggcggcgaagagagcgcaggggcttccttcctgcgtttcgacggcacgccgtggtccaccgacaaagacggcatcatcatgtgtctgctggcggcggaaatcaccgctgtcaccggtaagaacccgcaggaacactacaacgaactggcaaaacgctttggtgcgccgagctacaaccgtttgcaggcagctgcgacttccgcacaaaaagcggcgctgtctaagctgtctccggaaatggtgagcgccagcaccctggcaggtgacccgatcaccgcgcgcctgactgctgctccgggcaacggtgcttctattggcggtctgaaagtgatgactgacaacggctggttcgccgcgcgtccgtcaggcacggaagacgcatataagatctactgcgaaagcttcctcggtgaagaacatcgcaagcagatcgagaaagaagcggttgagattgttagcgaagttctgaaaaacgcgtaaacacattaaataagaaaaagggcggtcggaagatcgcccttttttacgtatgacaaacacagaattgcctgatgcgctacgcttatcaggcctacgaggatggtgcaatatattgaatttacgcgattttgtaggccggataaggcgttcacgccgcatccggcaaaaacaacgaacactttgtcaacaaactgagtagctcaaggaaatcccaatgaagaccaacaggagtctggtcgtcatagtgtcactaattaccgccacattactgctgactgcatgcgcccaacctgaacaatcatcattagctggcgactggttactgacccctaaagataaaaccagaggattaacgggtagcattgcggtaaatattgcaccttcccggtgtaagacaaattgccgtggtgataacttacctgataatacccgccgctggcagttgtcaggcgggaacgaaaaagaacttacttatcttcataatatgtcagcacaagaaaaggtcggtttaaatcccggttggcaatgctacacctcattttttatgcgggtttgccagggcaagcccggcactcgaccgatagtcaatgaggattatgtcagcgaaagcggattttttggctcgatgatgcatgtcgggattattgagttacgacgctgccagtcagaaaattgccagcaagaattgaaagcgataaatacaggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctatctctgctctcactgccgtaaaacatggcaactgcagttcacttacaccgcttctcaacccggtacgcaccagaaaatcattgatatggccatgaatggcgttggatgccgggcaactgcccgcattatgggcgttggcctcaacacgattttacgtcacttaaaaaactcaggccgcagtcggtaacctcgcgcatacagccgggcagtgacgtcatcgtctgcgcggaaatggacgaacagtggggctatgtcggggctaaatcgcgccagcgctggctgttttacgcgtatgacagtctccggaagacggttgttgcgcacgtattcggtgagcgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataagttggagtcattacctaattttgtgttttatatttgcgttaagaaattaaacctgccaaataataatatttggtgcaggtttaataataaattaatcactatttaagcgaatttattgaataacaattcaaagcataaaccgatacccaataccggtttcagtaatgaaatggcgtgggcgggcgggatcctgttccagtttttgtcgcagatgtcccatataaatacgcaaatagtgactgtgttcgaccgcgtttggcccccacacctggttaaggagctggcgctgggtgagtacttttccggcattgttgagcagcaccgccagcaggcggaactcaattggtgtgagatgcacctcttcctcaccccggtgaatcacgcgggcggctaaatcgacggtaacatcggaaaatttcaccagcggatcgggtgcggtggtggcagagtggcggcgtaatgcgacgcgcagacgggcctgcaattcgccaatgccaaacggcttactcagataatcatccgctccggcatccagcgcggcgattttgtcgctctcttcgctgcgtgcggaaagcacaatcaccggcaccgcactccactggcgcaggtcgcggataaactcaatcccatcaccatcgggcaggccgagatcgagaataatcaaatctggcttacgggtagccgcttccagcaagccgcgttgcagcgtttcggcctcatagacgcgcatcccgtcgccctccagcgccgtgcgcagaaagcgacgaatagcctgttcatcttcaacaatcagaacgtttgtcacatatcctcatgaaattcttcaagttcaggggcagtttgctggggaagtgtaacacgaaaacaggcaccaccttccggtcggttgaacgcggtaatagtgcccccgtgtacatccactatcgcccgacaaattgccagtccaagccctacccccggtactgccgactctttattcccgcgagcaaacttatcaaatatcgtctgctcctggcctggcggaagaccggggccgttatcccagacatccagttgtagattttcgccctcaacgtgggcatcgataccaatttcggcctgcgcacccgcatatttcaccgcgttctccagcagattaatcagcacccgttcaaagagtggcccgtcaacgtggattaaggtcagcggttctggcagagaaagattgatgggcgacgataaacccggttccagcatttgcagcgcgctgccgaccacttcttccagcgttaaccactcttttttcaaattaaagccgccggactgaattcgcgccatatccagtagattattcaccagtcgggtagtgttcagcacgtgctgacggatctcgctggcctggcgggcgtggggcgatccttcgcttgccagatcgagcgttaagatttctgcctgaccgaacaacaccgtgagcggagtgcgtaaatcatgcgaaagcgccgccagcagggcgttgcggatctgttcacgttcgcttgccatccgcgcctgttcttcgctggcggttagcgtcagccgctcaagcgcattggcgactaacagcgtaaacgtctccagcaggcgctgctgctccggaatcatcaactgacgcagattccccggttccaccaccaccagtccgtaggttttctcgccgctttttaacggcaaaatttggtacggtacaccgggtaacgtgtcggtgcccgcacccgcaggcaggcctttatcaaaactccactgcgcgatggcatcgtcccacggcgtcattccttgcggatgtgttaacggctgcaatttaccgttgtcatcgggcaacaacacctgactgcgggcatgaaacgtggaggcaataaattgttcgctggtggcggcgatgtcctgcggactgcggcccaccgccagagctttcgacatttcatataagtgccgtgtgcgttgctcgcggtaacgggctacccgcgcctgataacgcacacccgcagtaaggttcccgatcaccagcccgacggttaacatcaccgcgaaggtcagcagatattgcacatcagagacggcgagcgtgccgcgtggggcgataaaaaagagatcgaaactcaccacattaatgacggtagcaaccaccgaaggccagcgtccataaaatagcgccaccaccaccacgccaagcagatacagcatcaccaggttggcggcatcaaacgccatcagccactgcatggcaattaaggtgataacggcgcataacgcggcggcaaccacgcatccctgaatctgtacccgccacttgtctttaaaagagcggctatccggcgcgttgttaatcgtgcgggcgggtggttcatcaagcgcgaccagcacctgatcgagatcgggggcgatgcgcgccagtcggtcagcaaacgtttcccgacgccaccagcggcgcgaggctgggcgaccgagaataatcttgccgagattatgttcacgggcataacgcactaccgctttctcttccgctggatcagaaagtgttgccgtctccgcgcccagctcctgcgccagacgtaaggcgctgagaattgcccgacgttttttctccggtaagcgatgcagggcaggggtttcaacatacaccgcgtgccagacgctccccagccgtgacgccagccgcgccgccgcgcggaccagtttttcgctgccggtgttatggccgatgcataaaaggatcgcgtcgcgcgtgtgccagactttctcttcgccaggatgcccccgccaggcgcgcatttgctcatcaacgcgatcggcagtacggcgcagtgccagttcgcgcagggcgatcagattgcctttgcggaaaaaatgttcaatggcgcgctccgcctgcccggcaatatagactttgccttctttcagccgctggcgcagatcgtccgggggcaagtccaccagcaccacgtcgtcggcggcatcgaaaaaaggatcgggcacggtttcccgtacctgaattccggtgacgccgctgaccacatcattcagactttccagatgctgaacgttgacggtagtaaaaacatcaatgcctgcttccagcagctcttcaatatcctgccagcgtttgggatgacgagaaccaggcgcattactgtgcgccagttcgtccattaagatcagcgccggacggcgggcgagggcggcatcgagatcaaactcgctgatatgccgcccacggtacgccaggcgttttggcggcagaacagccagctcttccagcatggcggcggtatctttccgcccgtgggtttctaccacgccaaccacaatatccagcccttgcgtccgcagtcgctgtgcttctgccagcatcgcccaggtcttcccgacgcctgcacaggcaccgaagaaaactttcagcttcccccgatgcggcgcggcagtttgttccagcagacgatcggggtcgggacgtaagggttcgttattcatcaagtttatccagcgccagattgagttcaacaatgttgacgaccggctggccgatatatttcaccagcggttgttggctgtattttgcgatcagttgcgtgagctgttcaacgctgagattacgcgctttcgccacgcgtgggatttgccaggccgccgcttgcggggtgatattattgtccagcccgcttgccgatgccgtcaccagttcaaccggaacgctcgtgctggcatccgggttagcggcccgtaatgcagcaacgcgtgcggctattagtttatccagctcagggttactgactgccagattgctcccgccagaagcctgtggattatagggcatttctgccgttgccgacgggcgaccatgaaaatagccgttgccggtaaaattctgcccgattaatgccgagccacgcaccgtatcaccttcacggatcaacgaaccgttggcctgccagggaaaccaccattgccccagcgcggtggtcagcagcgggtaaacaccgccagtaatcaataacagaaagataaatgtcgataatgccggacgtaatccactcatggtaaacctcacaccagaccgcaaacggtcagcagtaaatcaatgactttgataccaataaacggcaccagcagcccacccagaccgtaaatccataagttacggcgcaacatggcagaagcggtaagcggtttataactcacgccttttaacgccaggggaatcaaaaagacgataatcaaggcgttgaaaatgaccgcactgagaatggcggagtcgggcgaatgcaggcgcatgatgttcagcgcatttaactgcggatacgttgccgcgaacgccgccggaataatggcgaagtatttcgccacatcgttggcaatactgaaggtggtcagcgagccacgggtcatcagcatctgtttgccaatatgcaccacctcaatcaacttggtcgggttagagtcgagatccaccatattgcccgcttctttcgccgcctgagtaccggagttcatcgctaccgcgacatctgcctgcgccagcgccggagcatcattggtgccgtcgccggtcatcgccaccaaacggccttccgcctgatactgacgaatcaatgccagcttggcctccggtgtcgcttcggcgagaaaatcatcgacgcccgcttccgcagcaatggcggcggcagtcagacggttatcgccggtaatcatcaccgttttaatgcccattttgcgcagctgggcgaagcgctctttaataccgcctttgacgatatctttcagcgcaataacgcccagcacacgagaaccttccaccaccaccagcggcgtggctccctgacgcgcaacctgatcgactttttgatcaacatcggcagggaagtgaccgccgttagcctcaacatggcggcgaatggcatcgacagaacctttacggatcatgcggttgtcgatgttgatcccgctcatccggctttgcgcagtaaacggtacaaaggtggcatggagcgactgcacatcgcgctcgcgcaggttaaaacgctgcttggcgaggatcacaatactgcggccttccggcgtttcatcagccagcgaagccagttgtgcggcgtcagccagcgttttttcatccacgccctgcgcggggataaactccgacgcctgacggttaccgagtgtgatggtgccggttttatccagtagcagaacgtcaacgtcacctgccgcttcaactgcacgtccgctggtggcaatcacattcgcgcccagcatccggctcatcccggcgacgccgatcgctgacaacaggccgccaatagtggttgggatcagacagaccagcagcgccaccagtaccgttacgctgactgcattaccgccccacgcggaaaacggccacagcgtggcggttgccagtaaaaagacgatagtcagggcaatcagcaggatggtcagggcaatctcgttcggcgttttacgtcgctgtgcgccttccaccatcgcgatcatccgatccagaaatgtctcgccggggttaacgctacactcaatcaccagccagtcagaaagaatacgcgtgccgccggtgacggaggcaaaatcgccgccggattcacggatcaccggtgccgattccccggtgatggcgctttcatcgaccgatgcgccgccttcaatgacttcaccatcgcaggggataatatcgccagcttctaccagcacgatgtcacctttacgcagttgatcggcaggaactttgtctgccacagcgccatatttcggttcgcgcagcttgcgagcaaaagcggtttttttcacccctttcagactgttggcctgcgctttactgcggccttctgccagcgcctcggcgaaattagcgaacagtacggtgatccacagccaaccgctaatggccgcgctaaacagcgcattgccgggcatcgcaccgcttgccatcgcgatgctaatacaggtggtcagcagactgccgatccagacgataaacatcaccggattgcgccattgcgcctgcgggtttaattttttcaccgcttctttcagcgcctgaacgacaagtgttggttcgaatagcgccagttgtttacgactcatattcagtgctcactcaatatcatcaggagagatattccgccaccggaccaagcgccagggcagggataaaggtcagtgcgccaaccagcaacacggtgccgattaacaggccaacaaacagcgggccgtgcgttggcagcgtgccggagctggcggcttggctctttttactcaccagcgaaccggcaattgccatcaccgggataatcaccccgaagcgaccgacaaacatgcagaacgccagtaaacagttccagaacggagagttggcgcttaatccggcaaaggcgctgccgttgttgttagcggcggatgacacggcgtacagcacttcgctaaaaccatgcgggccagggttgagcatggcgctacgtccggcgtcggtcatcatcgccaacgccgcgcccatcagcaccagcgtcggggtaaccagaattgccagtgcagtcagtttcatctcgcgtacgtcgatttttttacccagatattccggtgtacgaccaatcatcagcccggcaataaacaccgccagcaggacaaacagcatcatgccgtaaagaccagaaccgacaccgccgaacaccacttcaccaatttgcatcagccacatcggcaccatgccaccgagagcggtaaacgaatcatgcatcgcaatcaccgcgccacaggaagccgccgtcgtcacgaccgcaaacaggctactgaccagcacgccgaaacggctctctttaccttccatattgatgctgctgtccgtgcccagtgccagcagatgaggattaccctgaacttctgcccacatcaccacgcctacgcagatgacaaaaatcactgacatcgcccacagcaacatgcgcccctggcggcgatcgcccgtcacttcaccaaaggcaaagcacagcgccgttgggatcaagaagatcgccagcatctgcacgaagttggtcagtgcggttgggttttcaaacggatgcgacgagttggcattaaagaagccaccgccgttagtaccgagcatcttgatcgcttcctgagaagctacaggccccatgggtaacagctgttgcgctccttcaacggtattcacagcctgataaggcagaaagttttgcagcgcaccttgttgaataaaaaacagtgcaatcaacaacgccacagggactagcacccataacgtgatgcgtagcagatcgacccaggcattcccgagcgtgctcatgctctggcgggtaaacgcacggatgagggcaaaaatcaccgcaatcccgctggcggcagaaagaaagttttgcaccgttaagcccgccatctggctgaaatagctcaacgtggtttcaccgctataagattgccagttggtattggtgacaaagctgacggcggtattcagcgccagatcccacgacagccctggcaactgctgtggattaagcggcagatagtgctgaccgagcaacataaaaaacagcaccgccagccccagcatgttcaggccgagaatggcacaaagatattgcttccagttcatctcacggtcagagacgccaagtgcgcgaaaaagtacgcgctcaacgcccgttgtaccgggaagaggaatgtcattaatcagccgcgccagcccgctgcctaaaggacgcgccagcaccattaacaccagtaaaaacgtggcgatcagtaagaacccttgcgcagccatcagaacgcctccgcattgatcagggcataaaccagataacccagtaataaaaacaccagcaatacgccggttatcacgcctgcactcacagtgcacctccagtggcctaaaagtgataccggaagggtagaattctggctgcaaagatttcgcaaaaatctgcgggcggggtgtaaaaaaagtataaaaatggcaaaagccatgatttaactaatgtttagtattaatttaacttttgtgtaacttaattacaggatgaatgtaaataaaccatcaataagcaaaaataagtggtcggatgagtagtaaaattacacaaaaggcggtactattttcatcagataaacaaattcatttttccggtcccattcaccgggtagatacaaaagggggagaaaagtatggaactctacagagaatatcctgcatggcttatctttttacgccgtacttatgcggttgcagcgggcgttctggcgctgcctttcatgcttttctggaaagaccgcgcccgcttttacagctacctgcatcgcgtctggtcgaaaaccagcgataaaccggtgtggatggatcaggccgaaaaggcaactggtgatttttattgattgctgagttttgaatacattgaaaaccgccagcggaaacgctggcggttttttgtatcaggaagatgttcagaggaatatttagacatcgttataccaatcgaaacatatattcatgaaatatatataaatattttcctaattgttcttatctgacagatatctcacttaaggctttcttataaatctgtagggtttcgcctgtcagcagacaaataacccgataaaacaaggatgagcagatgagcggaaaaccggcggcgcgtcagggcgacatgacgcagtatggcggtagcattgtccagggttcagccggggtacgcatcggtgcccccaccggcgtggcctgttcggtgtgccccggcggggtgacgtccggccatccggtcaatccgctgctcggtgcaaaggtccttcccggtgaaaccgacatcgccctgcccgccccgctgccgttcatcctctcccgcacctacagcagttaccggacaaaaacgcccgcgccggtggggagcctcggccccggctggaaaatgcctgcggatatccgcttacagctgcgcgataacacactgatactcagtgataacggcggcagaagcctgtattttgagcacctgtttcccggtgaggacggttacagccgcagcgagtcactgtggctggtgcgcggcggcgtggcgaaactggatgaaggtcaccggctggccgcactctggcaggcgctgccggaagaactccgcttaagtccgcatcgttatctggcgacaaacagtccgcaggggccgtggtggctgctcggctggtgtgagcgggtgccggaagcggatgaggtgctgcctgcgccgctgccgccgtaccgggtactgaccgggctggtggaccgcttcgggcgcacacagacgttccaccgcgaagccgccggtgaattcagcggcgaaatcaccggcgtgacggatggtgccgggcgtcacttccggctggtactgaccacgcaggcgcagcgggcagaagaagcccggcagcaggccatttccggcgggacggaaccgtccgcttttcctgataccctgccgggttacaccgaatatggccgggacaacggcatccgtctgtctgccgtgtggctgacgcacgacccggaatacccggagaatttacctgccgcgccgctggtgcgctatggctggacgccgcgcggcgaactggcggcagtgtatgaccgcagcaatacacaggtgcgcagctttacttacgatgataaataccggggccggatggtggcgcaccgtcacacgggccgaccggaaatccgttaccgttacgacagcgacgggcgggtgacagaacagcttaacccggcaggcttaagctacacgtatcagtatgagaaagaccacatcaccatcaccgacagcctggaccgccgtgaagtgctgcacacgcagggcgaagccgggctgaagcgggtggtgaaaaaggaacacgcggacggcagcgtcacgcagagtcagtttgacgccgtgggcaggctcaggacacagacggatgccgcaggccggacaacagaatacagcccggatgtggtgacgggcctcatcacgcgcatcaccacgccggatggcagggcatcggcgttttactataaccaccacagccagttaacgtcagccaccgggcctgacgggctggaaatacgccgggaatatgatgaattgggccgtctgattcaggaaactgcccctgacggcgatatcacccgctaccgttatgataatccacacagtgacttaccctgcgcaacggaagatgccaccggcagccggaaaaccatgacgtggagccgttacggtcagttgctgagcttcaccgactgttccggttatgtaacccgttatgaccatgaccgcttcgggcagatgacggcggtgcaccgcgaggaagggctgagtcagtaccgcgcatacgacagccgtggacagttaattgccgtgaaagacacgcagggccatgaaacgcggtatgaatacaacatcgccggtgacctgaccgccgtcattgccccggacggcagcagaaacgggacacagtacgatgcgtggggaaaggccgtccgtaccacgcagggcgggctgacgcgcagtatggaatacgatgctgccggacgggtcatccgcctgaccagtgaaaacggcagccacaccaccttccgttacgatgtactcgaccggctgatacaggaaaccggctttgacggccgcacacagcgttatcaccacgacctgaccggcaaacttatccgcagcgaggatgaggggctggtcacccactggcactatgacgaagcagaccgcctcacgcaccgcaccgtgaagggtgaaaccgcagagcggtggcggtacgacgaacgcggctggctgacagacatcagccatatcagcgaagggcaccgggtgacggtgcattacgggtatgatgagaaaggccgcctgaccggtgagcgtcagacggtgcatcacccgcagacggaagcactgctctggcagcatgagaccagacatgcgtacaacgcgcaggggctggcgaaccgctgtataccggacagcctgcccgccgtggaatggctgacctacggcagcggctggctgtcaggcatgaaactcggcgacacaccgctggtggagtacacccgcgaccgcctgcaccgggaaacgctgcgcagcttcggccgttatgaactctccaccgcttacacccctgccgggcagttacagagccagcacctgaacagcctgcagtatgaccgcgattacacctggaacgacaacggcgaactcatccgcatcagcagcccgcgccagacccggagttacagctacagcaccaccggcaggctgaccagcgttcacaccaccgcagcgaatctggatatccgcatcccgtatgccacagacccggcaggtaaccgcctgcccgacccggagctgcacccggacagcaccctcagcatgtggccggataaccgtatcgcccgtgacgcgcactatctttaccggtatgaccgtcacggcaggctgacagagaaaaccgacctcatcccggaaggggttatccgcacggatgatgagcgcacccaccagtaccattacgacagtcagcaccggctggtgcactacacgcggacacaatatgcagagccgctggtcgaaagtcgctatctttacgacccgctgggccgcagggtggcaaaacgggtatggcgacgtgaacgggacctgacgggctggatgtcgctgtcacggaaaccggaagtgacctggtacggctgggacggcgaccggctgaccacgatacagaacgacagaacccgcatccagacgatttatcagccggggagcttcacgccactcatcagagttgaaaccgccaccggtgagctggcgaaaacgcagcgccgcagcctggcggatacccttcagcagtccggcggcgaagacggtggcagtgtggtgttcccgccggtgctggtgcagatgctcgaccggctggaaagtgaaatcctggctgaccgggtgagtgaggaaagccgccgctggctggcatcgtgcggcctgactgtggagcagatgcaaaaccagatggacccggtgtacacgccggcgcgaaaaatccacctgtaccactgcgaccatcgcggcctgccgctggcccttatcagtaaggaaggggcaacagaatggtgcgcagaatacgatgagtggggcaacctgctgaatgaagagaacccgcatcagctgcagcagcttatccgcctgccggggcagcagtatgatgaggagtccggcctgtattacaaccgccaccgctattatgacccgctgcaggggcgatatatcactcaggatccgattgggctgaaagggggatggaatttttatcagtatccgttgaatccgatctcaaatatagatccattaggattagaaacactaaaatgcattaagccactgcattcaatgggcggaactggtgaaagaagcggtccagatatatgggggaatccgttctatcatcaatatctttgtgtcccagatggtaaaggggactatacttgtggtggccaagaccaacggggagaatcaaaaggagatggtctatgggggccaggtaaagcaagtaatgatacaaaagaagctgctggccgttgtgacctcgttgaaaccgataatagttgtgtggagaactgtttaaaagggaagtttaaagaggtaaggccgcgttattctgtattgcctgatatattcacacctataaatttagggctatttaaaaactgccaagactggtctaatgattctttagaaacatgtaagatgaagtgctccggaaataacattggacgttttattagatttgtattcaccggagtgatgtaatgaaatatattatttttttattcagagctatatggctggctttatcgcttttaatactattcttttccatgcatagactttcactattagactccactcgtgatgtgagcgagttaattagtctcatgtcttatggaatgatggtaatatgttttccaacaggcatagtattctttattgctctaatatttatagggactgtatcagacattattggcgtaaggattgatagtaagtatattatggcgataataatatggctttattttctgtcaggagggtatattcaatggtttgtattaagtaagcgcattataaacaaataaattaagttaattgctcttattattatatgtaacctgggcattgatatcccgtatgccacagacccggcaggtaaccgcctgcccgacccggagctgcacccggacagcgccctcagcatgtggccggataaccgtatcgcccgtgacgcgcactatctttaccggtatgaccgtcacggcaggctgacggagaaaaccgacctcatcccggaaggggttatccgcacggatgatgagcgcacccaccggtaccattacgacagtcagcaccggctggtgcactacacgcggacacaatatgcagagccgctggtcgaaagccgctatctttacgacccgctgggccgcagggtggcaaaacgggtgtggcgacgtgaacgggacctgacgggctggatgtcgctgtcacggaaaccgcaagtgacctggtacggctgggacggcgaccgcctgaccacaatacagaacgacagaacccgcatccagacgatttatcagccggggagcttcacgccactcatcagggttgaaaccgccaccggtgagcaggcgaaaacgcagcgccgcagcctggcggatacccttcagcagtccggcggcgaagacggtggcagtgtggtgttcccgccggtgctggtgcagatgctcgaccggctggaaagtgaaatcctggctgaccgggtgagtgaggaaagccgccgctggctggcatcgtgcggcctgacggtggagcagatgcaaaaccagatggacccggtgtacacgccggcgcgaaaaatccacctgtaccactgcgaccatcgcggcctgccgctggcgcttgtcagcacggaaggggcaacagaatggtgcgcagaatacgatgaatggggcaacctgctgaatgaagagaacccgcatcagctgcagcagcttatccgcctgccggggcagcagtatgatgaggagtccggcctgtattacaaccgccaccgctattatgacccgctgcaggggaggtatatcactcaggatccgattgggctgaaggggggatggaatttttatcagtatccgctgaatccggttcagtatatagattcaatgggactggcatcaaaatatggacacttaaataatggcggatatggagcgagacccaacaaaccgcctacgcccgatccaagtaaattgccggacatagcgaaacaattaagactgccatatcctattgaccaggccagtagtgcgcctaatcttttcaaaacattcttcagagcattaagcccttacgactacacactgtattgcaggaagtgggtaaaaccaaatctgacttgtacgccacaggatgattcccagtatccagggatggatacaaagacagcaagtgattacctgccacagacaaattggccaacaactcaattaccaccaggatatacttgtgcagaaccctatttattcccagacattaataaacccgatgggccagcaacagcagggatagatgatttgggtgaaattttagctaagatgaaacagagaacatcgagaggaataagaaaatgaaaagagttttgttctttttgctgatgatatttgttagttttggtgttatagctgattgcgaaatacaagctaaagatcatgattgttttactattttcgctaagggtactattttttccgcgtttcctgtcttaaataataaagccatgtggagatggtatcagaatgaggacatcggtgagtattattggcaaacagaactgggtacatgtaaaaataataaattcacaccaagcggggcgagactcttaattcgcgtcgggtcactacgccttaatgaaaatcatgccatcaaaggaacgttgcaggagttgataaatacagcagaaaaaacggcgtttctcggcgatcggtttagaagttatataagagcgggtatctatcaaaaaaagagcagtgatccagttcagttgttggcagtccttgataattcaatcatggtaaaatattttaaagatgagaaaccaacttatgctcgaatgacagcacatctcccgaacaaaaatgagtcttacgaatgtttaataaagatacagcatgaactaattcgtagtgaagagaaataaaatctcttcctgagaaaacaaattaatcattgtgaaaaattatataactcatggaataggtgtttattttgcgttccatttgcagggaaagatcacgtaacgctacttttttgtactaaataattcgaattttaagttcaacaattgagatactacttattgtctaaagctgtttttcatagcttatacatgatcaaatactccttacataaataaggtgaacaaatggaacttaaaaaattgatggaacatatttctattacacccgattacagacaagcctggaaagtggtgcataaattgtcagatattctactgttgactatttgtgccgttatttctggtgcagaaggttgggaagatatagaggatttcggggaaacacatctcgattttttgaagcaatatggtgattttgaaaatggtattcctgttcacgataccattgccagagttgtatcccagggaaagatcacgtaacgctacttttttgtactaaataattcgcattttatgtttaaaaattgagatattccttattacctaaagctgtttttcatagcttatacatgatcaaatactccttacataaataaggtaaacaaatggaacttaaaaaattgatggaacatatttctattattcccgattacagataagcctggaaagtagagcataaattgtcaggcatcctactattgactatttttgccgttatttctggtgcagaaagttgggaagatatagaggatttcggggaaacacatctcgatttcttgaagcaatatggtgattttgaaaatggtattcctgttcacgatactattgccagagttgtatcctgtatcagtcctgcaaaatttcacgagtgctttattaactggatgcgtgattgccattcatcaaatgataaagacgtcattgcaattgatggaaaaacgctccggcactcttatgacaagagtcgccgcaggggagcgattcatgtcattagtgcgttctcaacaatgcacagtctggtcatcgggcagatcaagacggataagaaatccaatgagatcacagctatccctgaacttcttaacatgctggatattaaaggaaaaatcatcacaactgatgcgatgggttgccagaaagatattgcagagaagatacaaaaacagggaggtgattatttattcgctgtaaaaggaaaccaggggcggcttaataaagcctttgaggaaaaatttccgctgaaagaattaaataatccagagcatgacagttacgcaatgagtgaaaagagtcacggcagagaagaaatccgtcttcatattgtttgcgatgtccctgatgaacttattgatttcacgtttgaatggaaaggactgaagaaattatgcgtggcagtctcctttcggtcaataatagcagaacaaaagaaagagccagaaatgacggtcagatattatatcagttctgctgatttaatcgcagaaaagttcgccacagcaatccgaaaccactggcacgtggagaataagctgcactggcgtctggacgtggtaatgaatgaagacgactgcaaaataagaagaggaaacgccgcagaattattttcagggatacggcacatcgctattaatattttaacgaatgataaggtattcaaggcagggttaagacgtaagatgcgaaaagcagccatggatagaaactatctcgcgtcagtccttgcggggagcgggctttcgtaatctttccctgctttttgtactaaataattcgcattttatgtttaaaaattgagatattccttattacctgaagctgttttttattgcttatacatgatcaaatacttcttacataattaaggagaacaaaatggaacttaaaaaattgatggaacatatttctattatccccgattacagacaagcctggaaagtggaacataaattatcggatattctactgttgactatttgtgccgttatttctggtgcagaaggctgggaagatatagaggattttggggaaacacatcccgattttttgaagcaatatggtgattttgaaaatggtattcctgttcacgataccattgccagagttgtatcctgtatctgtcctgcgaaatttcatgagagctttattaactggatgcttgactaccattcttcagatgataaagacgtcatcgcaattgatggaaaaatacaccggcattcttatgacaagagtcgccgtaagggagcgattcatgtcattagtgcgttctcaacaatgcacagtctggtcatcggacagatcaagacggataagaaatccaatgagatcacagctatccctgaacttcttaacatgctggatattaaaggaaaaatcatcaaaaccgatgcgatgggttgccagaaagatattgcagagaagatacaaaaacagggaggtgattatttattcgctgtaaaaggaaaccaggggcggctaaataaagccttcgaggaaaaatttccgctgaaagaattaaataatcccaagcatgacagttacgcaattagtgaaaagagtcacggcagagaagaaacccgtcttcatattgtttgcgatgtccctgatgagcttattgatttcacgtttgaatagaaagggcagctatggttagaaactacctgacgtcagtccttgcggggagtaggctttcgtaaatttgtcctgctacaacaggattaacttcacaaatatcatttctcaacgtctacacttactcctgtaaaccgctcaggagcagtaatgaatctacaacgatttgatgacagcaccctaatccgtatctttgcccttcatgagttacatcgactgaaagaacatggcttaacgcgcggggcgcttctcgattatcacagccgctataaactcgtctttctggcgcattctcagccggagtaccgcaaacttggcccgttcgtggctgatattcaccagtggcaaaatctggatgactattacaaccagtaccgccaacgcgtagttgttttgctttctcaccccgccaacccgcgcgatcacaccaatgttttgatgcacgttcagggttattttcgcccgcatattgattccacagaacgccagcagctggctgcgcttatcgacagttatcgccgtggcgagcaaccacttcttgcgccgctgatgcgtatcaaacactatatggcgctttatcctgacgcctggctttcagggcagcgttatttcgaactttggccgcgtgtgattaacttgcgccattcaggagttttatgactacccatctggtctggtttcgccaggatttacgtctgcacgataatctcgcactggctgccgcctgccgcaattcgtctgcacgcgtgctggcgttgtatatcgctacaccacgccagtgggcgacgcataacatgtcgccgcgtcaggctgaacttatcaatgctcaactgaatgggctacaaatagcgcttgcggaaaaaggtattcctttattgttccgtgaagtggatgactttgtcgccagtgtcgaaatagttaaacaggtgtgcgcggaaaacagcgttacccacctgttttataactatcagtatgaagtgaatgagcgggcgcgggatgtggaagttgaaagagcgctgcgtaacgtggtgtgtgaaggatttgatgacagcgtgatcctgccgcctggcgcggtgatgaccggtaatcacgagatgtacaaagtctttacgccttttaagaatgcctggctgaaacggctgcgggaagggatgccggagtgcgtcgctgcgccaaaagttcgtagtagcggatcgatagagccctcgccatccattacgctgaattatcctcgtcagtctttcgatactgcgcattttccggtggaagaaaaagcggcgattgcgcaattacgccagttttgccagaacggtgccggagaatatgagcaacaacgagattttccggcagtggaaggcaccagccgtttgtcggccagcctggcaacgggcgggttatcgcctcgccagtgcttgcatcgcttgttggctgaacagccgcaggcgctggacggtggggccggtagtgtctggcttaatgagctgatctggcgcgagttttaccgtcacctgataacgtatcacccctcgttgtgtaaacatcgtccatttattgcctggacggatcgtgtacagtggcagagcaatcccgcacatttacaggcctggcaggaaggcaaaacgggatacccgattgttgatgccgctatgcgtcagcttaacagcactggctggatgcataacaggctacggatgattacagccagttttctggtgaaagatttattgatcgactggcgcgaaggcgagcgatatttcatgtcgcagctgattgatggtgatttggcagccaataacggtggctggcagtgggccgcttcaaccggaaccgatgcagcgccgtattttcgtattttcaacccgacaacccagggcgagaaatttgatcatgagggcgagtttatccgccagtggctaccggaactgcgcgatgtgccagggaaagtggtgcatgagccgtggaagtgggcgcagaaagcaggtgtgacgctggattatccgcaaccgatagtcgagcacaaagaagcgagagtacaaacgttggcagcgtatgaggcggcgcggaaggggaaataacagacgcgtcaggcaatcgagcccagatgccggatgcggcgtgaacgccttatccagcctacaaatttgtgcaaattcaataaattgcaggaaatacgtaggcctgataagacgcgtcaagcgtcgcatcaggcatcggtgctggcctattaagactccagcgccagcgcgcggtttctgaatttcagcgcctgatacagccaaatcatcagtaccagtcctacacacgccagtgcgccccaggtaatttgatcaaatacttcaatatatgcattgatggagtagttgatcgccccggaagcatcaaacgaagcctgcgatgtctgatcggcaatcacgcccgccagatagttcgcgatcgcgccagaaagcagcatgtagatgccggttaatacgccggtcacaccggggatttcaatgcgcgtaatttgcgacatggcaaccgggtcgataaacagttccgcaaagcccatcaccgccaggcctaataccatcagtggcagagaagagtgaccatacattgcggaccagcgggcgcttaaggtcagaatgcagaatccggcgctcatcaggccaaggccaagagcaaatttcccccagatgcgcacggtacgattacccgcgacactctcttttaccacccacgccaggaacacaccgcacagcataactgcgaaggcattaatcgactggaacatcgcggtcggaacggtataaccaaacatatcgcggttaacgaagcggtcgatataaaggctaatcgagctaccgccctgttgtgcgaaggcccagaacaacatactgaagaaggtgagcgtcacaatcagccccagctccttccgctgtttctggttttctgctttgcgataaatttttgccagtacacccaggccaataatagtcgcgacaattaaggcgtataccgaccactctttccagaacagtatggtaatcagtgcaggcgttgccaccagcagaaccagcagccatccccagttcggcaggagaaagtttgtcgcacgcagtacttttttgttaacgccgcgggtatgagtgaaatgacgattgccacataagaaaatgaccagacccgcgatcatgccaaccgccgccaggccaaagcccatcgcccagctgtactcttcctgggcgtaaccacaggcgataggtgcgataatagaccccacgttacccgccgcatacatcagcgagaaaccgccatcacgacgcggatcggttggctcatacagctcgccgagcagacagcttacgttagatttaaacaggccatagccgcagacgataatcgccagggacagatagaggaatgacggatggatctcactggcacccagcaccacatgaccgatcgccatcaacaacgcccccagcatcaccgccatgcgattgccgagaactttatccgccaaaaagccaccgaggattggcgtgacatacaccagcgaacagtaggcgctaaataactcgtaggcgtgagtatcgttgtattttagttgattggtgagatagagaatcagcagggcacgcatgccgtaaaagctaaaatattcccagatttgcagcgcaacgacatagtaaatagcgcgcggctgtgatgcgtgtttattcataataattccacaattgacggcaacgtcacgtaatagttgcgcggcgtgcttgtgtttccttaaagttaaaactttgatacagatctgattatttatgcaatatgctgtctgattgcataaatatacattagctgaagcgtgatgatataaacaatttgcgtcttttggcgtcgggtttgtttcttaatatgtcaaaagattggctatcgacgaactggcgaggtaacgctatgttaacggtgtagctatcagaatacggaaggcgcgaagatgaaaaacaccgaactggaacaactgattaacgaaaaactgaacagcgcggcgattagtgattacgcgccgaatggtttgcaggtggaaggcaaagagacggtgcaaaaaattgttaccggtgtcaccgccagccaggctttgctcgatgaggcagtgcgtctgggcgcggatgcggtcattgtgcatcatggctacttctggaaaggagagtctccggtcattcgcggaatgaagcgtaaccgtttaaaaacgttgctggcgaatgatatcaacctgtatggctggcatttgccgcttgacgcacatcctgagctgggcaataacgcacagctggcggcgttactggggatcacggtcatgggcgaaattgagccgttggtgccgtggggcgaactgaccatgcctgtgccgggactggagctggcttcctggattgaagcgcgtctgggacgtaagccgttatggtgtggcgataccggacctgaggtggtccagcgcgtcgcctggtgcacgggcggcgggcaaagttttatcgatagcgccgcgcgttttggcgtggatgcttttattactggcgaagtttctgaacagaccattcattcagcccgcgagcagggattgcatttttatgctgcaggtcaccatgccactgaacgtggtggtattcgcgcattgagcgagtggctgaatgaaaataccgatcttgatgtgacctttattgatattcctaatcctgcataacgaataatcagagggatcgaaagtgcaacgagcgcgttgttatctgataggtgaaacggcggtagtgctggaactggaaccgccggtgacgctggctagccagaaacggatctggcgactggcgcagcgtctggtggatatgccgaatgtggttgaagccattcccggcatgaacaatatcacggtgattttgcgtaatcctgagtcgctggcgctggatgccatagagcgtttgcaacgctggtgggaggagagcgaggcgctggagccggagtctcgctttattgaaattccggtggtttacggtggtgcaggcggaccggatttggcggtggtcgcggcgcattgcgggttgagcgaaaaacaggttgttgaattgcactcctccgtggaatacgtggtctggtttttaggttttcaaccgggcttcccgtatctcgggagtttgccggaacaactacacacgccacggcgcgctgaaccgcgcttactcgttccggcaggttctgtcgggatcggcgggccgcagactggtgtttatccgctggcaacgccgggtggctggcagttgattggtcatacctcactcagcctgtttgatccggcgcgtgacgaacccatcttattacgtccgggagacagcgtgcgctttgtaccacagaaggagggagtatgctgaagattattcgtgcgggcatgtataccactgtgcaggatggcggtcgtcacggttttcgccagtcgggtatcagccactgcggcgcactggatatgcccgcgttacgcattgctaacctactggtgggtaatgacgccaatgcccccgcgctggagatcacgctcggtcagttaactgttgagttcgaaactgatgggtggtttgctctgacgggtgccggttgcgaagcgcggctggatgataatgccgtctggaccggctggcgattgccgatgaaagcaggccagcgtttaacgcttaaacgcccgcagcacgggatgcgcagttatctggcggtcgcgggtggtattgatgttccgccggtaatgggctcatgcagcaccgatctcaaagtggggattggcgggctggaaggccgtttactgaaggatggtgaccgactcccgattggcaaatcgaagcgtgattctatggaagcgcagggcgttaaacagctgctgtggggcaaccgcattcgcgccttgccggggccggaatatcatgagttcgatcgcgcctcgcaggatgcattctggcgttcgccctggcagcttagctcgcaaagtaaccgcatgggctatcgcttacaggggcaaattttaaaacgcaccaccgatcgcgaactgttatctcacggtttgttaccgggcgtggtgcaggtgccacataacgggcagccgattgtgttgatgaacgacgcacagaccaccggtggttacccgcgtattgcctgtatcattgaggctgatatgtaccatctggcgcaaattccgctcggtcagccgattcattttgtccagtgttcactggaagaggcactgaaagcgcggcaagatcagcaacgttattttgaacaattagcgtggcggctgcacaatgaaaattgacctgaatgccgatctgggcgaaggctgcgccagcgacgcagagctattaacgctggtttcctctgccaatattgcttgtggatttcatgcaggcgatgcccaaaccatgcaggcttgcgtgcgtgaagcaataaaaaatggtgttgcgattggcgctcacccgagttttcccgacagggaaaattttggtcgcagcgccatgcagctgccgccagaaaccgtttacgcccagacgctgtatcaaattggcgcgctggcaacgattgcccgtgcgcaaggcggcgtaatgcgtcatgtcaaaccgcacggcatgttgtacaaccaggcggcgaaagaagcacaactggcagacgccatcgccagagcggtatacgcttgcgatccagcattggttctcgtcgggctggcaggaagcgagctgattcgtgcaggcaagcaatatggcctgacaacgcgcgaggaagtgtttgccgatcgcggttatcaggctgacggctcgctggtgccgcgaagtcagccaggtgcgttgattgaaaacgaagaacaggcgctggcgcaaacgctagagatggtgcaacacggcagagtcaaaagtatcaccggcgaatgggcaacggtcacggcgcaaacagtctgcctgcatggcgacggcgagcacgcactggcgttcgcccgccgactacgctctacatttgccgaaaaggagattgttgtcgcagcataaccccgattaataaagaatgaaaaaaggatatcaccatgcctgaaggcccggagatccgccgtgcagcggataacctggaggcggcgatcaaaggcaaaccactaactgatgtctggtttgccttcccgcagttaaaaacttatcaatcacaacttatcggtcaacacgttacccatgtggaaacgcgtggtaaggcgttgttaactcatttttccaacgacttaacgctctacagccataatcagctttacggcgtctggcgcgtggttgataccggcgaagagccgcagaccacgcgagtattgcgggtaaaactgcaaacggctgacaaaaccattctgctttatagcgcctcggatattgagatgttgaggccggaacaactgaccacgcatccgtttttacaacgcgttggtcccgatgtgctggatccgaatctgacgccggaggtggtaaaggaacggttattgtcaccgcgctttcgtaaccgtcagtttgcaggattactgctcgatcaggcgtttctggctgggcttggcaattatttgcgggtggagatcctctggcaggttgggttgactggaaatcataaagcgaaagatctcaatgcggcgcaactggatgcactcgcacacgcgttactggagattcctcggttttcttacgctacgcgggggcaggtggatgagaataagcatcatggggcgctgtttcgctttaaggtttttcatcgtgatggcgaaccgtgcgaacgctgtggcagcatcattgagaaaaccacgctgtcatctcgcccgttttactggtgccctggctgccagcactaggccgaccgcttcggcgcataggttgaaataaaccgcgcaatggctggccccgtcagcaaaatactgaacaggcgcagggtttgcatcgccataataagcgccatatcggcattgctccctgcggcgatgaccgccacggtatcaagcccgccgggactggtggcgaggtaggcagtcataaaatcaatgtgcataaaccgggtcagcccccacgccatacccgcacaaatagccagcagagcaaaaatcgacagcaggatttgcggtagtgggcgtagtgcccgcagtaagatttgtttatcgaaaccaagaccaatccgccagccaattgccatatacgccatcgccagcagccattccggtagttcgatggtgatgagctgaccagactggagcactgcgcccgccagcatcgggatgagcatcgtgccggaaggaagacgcagcatgcatcccgccgtaccggcaacgactgcgagcaaaatcgtaagcaggagattaatgctcactggcgggaaccagacgatttgctggttaaccgcttcagcgttatcacccagcatcatgcgggtgaccagaacagcggcccccgcgacgaacagcactcgcagatattgcataaacgccaccaggcgaatatctgcgccgtaatcttgcgccatagcgaccattgccgctgcgccgcctggagaagaaccccaggcaccggtatttccaggcagtgagctatagcgcaccaataaccaacccacgatggcgctggaaagcagcgtcaccagtaaaatagcaagcacgatcggccagttggcggccagcgtggtgagaatcgaaccagtgaggttttgcgcaatcatgcagccaagaatggcctgggcggcgagaaaagcggagcggggaagttgcagagtaattccgcgcatactgaagatgatcccggcgatcatcggcccaagtaatagcgccgccgggagatgtaccgcgaggaaaccaatagaaaggagaagtgatagcacacataacattccccactgcaaaactggcatccttcgctccctcattattttctctttggtgtatcgatacagcataaagaaagccgggccaggaaaaaataacagcaatcaaggaaaaggggaaaatcagcaattttctgaaagagatgccctttccggctgcaaagggcatcatggcaaatcagttatagttaattttaaaaagcaccactgtatcgaagggcccagcctcgatgggggtacctgcaatggaagaaagttcagctgtataggttttttcgtagaccaacatgtcgctggtgaaatcggcgtattcagcatatttattgaaggtataaggcgaggcgttttcatccagcaaacgtagcttcagaccattaccaatcaacaatgctttatcttcttcaaccaacgtttcttcggtataaaaggaggaactgactttaaatccgtcggtgcattggtcattttgtgattttgtcgtcttaatactgaatgttttcgacattgtgtggcgacgaatatccagcaaattaaatttaccaaaatcaatcacctgtgtttccggtgaaatggaaaaattgacgctgcaatccagcacgcgaatgttttccagaccagtaatatgatatttcaggttttgggcagtagggtcttcgttaacgctaccggcaccgtcaaattgcacgacgatatagtcgctaagcgtactttgataatcatgcggcggcatttctcgtattttgacgtataaccgcatgcgagcgagaaaggtacgcgacatgtgaatattagcgggatcacccgagcaaattttgttctgccatcccatcgcgataatctgctcaggggtgtaaatgtcaatgttcttactgtcaatacactggttagtgtcgatgcggctttttccctggttggcgtcataatcaacgccattgtaagttacgccgagttgataatagcgatcctgcacccccgggtaggggtttacccaggcataaacatgctcactttcaaaattgccgttggtattgttgtcacaatagacgggaattttaatatcgtcagattcccaaatcttatcgccgagtttggcattgcctggtacagcaaaaggttgaatcgcttctgatttttctaccgagccaccggatgaaccaaagtagcagttcagggcaagcgcagacttcaacggcagaaataacagacagatgacgagcaacactcccttgccagcactcatttcttcgcctccacggcttgtaaatggcattgtccgctgcagttgagcatcgtcatgcgtaacgcgccgtaatcatccatataaccgagatagaactggctgccgctatagcttccggtgtttgtgttgaccgtactaaaaggcgcaaccatcacggttttgaagccggggagaacgcctttttcatttcgtcccaggtaggcaatggtcagataatacgcggtaggatttttcagtgtcagttggttaccctgctggctgacctgtaactgcagttcgaccttttctcctgctttcttgcgtaatgcagccggtctccagaacaccttgatacgactctggatggcgacttgcaaaacggcatggtcgctgtttttttccggggcgggaggaacttcacgtatattgtagaaaaatagcgtttcgcgatcgcctggtaatttcgcggtcgacgcttgcttgactatccgcacctgcgttgttgctttcggttccagacgttgtatcggtggcagggcgaccagaagatcgtcgcttttctcccctttttcattttcgagccaggaataagcgaggtaggggagtttatcgctacgattatctactcgcagactggtagctttatcattagcgttgaacacaatacgagtgcgatcgggttgtagtgcagcgtggctgcacagactggcaaccaacaacaaaaggggtagtcctttcataaatgtcattttcatttccttaattaatgacaaggtaaaatcaggcgatttgcggtgtcttccatatgttcaggaagatggagcgagcaatgctggctatcaccccagaccacggtaaacttttgattttcagcgactccgcttaaccaggcatgtccttcctcgccaaccatccccacgctaatgccgctgtcatcctggcggatatccgctccgaggggaggaaactgaccgctggcgttgcgaatgatgacgttaacgtctttaccggaacgggaagccagtgatttgtaacctatcgcgccttcaatccacgtttctttgataacgttttctgtaactgttacgccgtcgggtaagtcattcatgttcaccgccacggtggaaggctgataactggaaatcaacggcaccaccgcaatgccaaaatggttggtgtagtcgagattgccctgaaccggaatatctgccacgccatcggtgctgaccatcaggcgaggttcattggtggagctgcggcgatgaaacgctgcaccatattgggttgcggtgaaagaaccgctccagctgctgctgacggaactgtaatcattggcggcataggtaccagaaatatcccactcacccgctgaactcaggtgctgatagttaccgctcacctgggctccattgtcaggacggtcggattgcagtccggcagacatgccccagctattacgttcatccagcgtatcgttccacgacatgcggtgtgtggtgctgtggctactgttttgcatgtcataaccaacccgaccaccattaccgaaggggagcgaaatcgacaggtaaatctggttgtcgcgatctttatcttcgtaatgggttgtattgaatgacgtcgaaatagagatatctctccagtcaccaatatcaacattaaaaccggctgtgatgttggcggtcgtggaggcgtctgcattccaccaggtttgatgtagcaggttggcgtaaagattgaggtttagtggggtaatcggttggcccacagataagctgatcgtctgtttttcgtcctgcgcatcgctgtcgttgtatttgtgatccagatagttggcgtagctgtgaaaatgacgatcggagaaacgataagcggcgagggaaatcgtgctgttagtggcatccacttgtttgctgtaattaaaacggtagcttaagccccgctcgtcctgctgagtatcaaaatggctactggcccacgtgacatcaaacgacagcgcaccaagccacagcatattttgcccaatacccattgcggcagaatggtagtcatcaccagaaagcagcaggccgccgtacagcgaggtgtttgacagcatcccccaggaaacttcattgctaaaaaaggtttcattttcagtttgatgtgacatggagggccgtggctgacccgcggccagtttatagcgaacctgtccctgacgagtcaggaagggcgtcgatgctgccgaaacctggaaattgttcacccgaccatcttcttccgtcactttgacatccagtgtgccctgaacagactgattaaggtcgtcaatgataaatgggcctggtgggacttttttctggtaaatgacgcggcctgattgactgatcgtcaccgtggcattggtctgtgcaataccgctaatttgtggggcgtagccgcgtagttcccatggcaacattcgctcgtcacttgccagtgccgcgccggtataagaaaaaccgtcgaaaatattggaactaaaatccgtttcgccgagggttaatttagagcctaattgcggtaatggacgaaaaagataggtgcgcgatattccgcctgactgttcatggttatcatcgctatcagtctgattcaactgataatcactacgtaagcgccatgccccggcgttaattccggtggtaccgtaggcgttcaggttagtgctgctgctgccgtcctgtgggcggtagctgctggcaaacaagttgtaatccatcaggataccggcgacaccttctttccatgtggagggtggggtccagttttctgagtgccacgccagccaggcttgcggaatggtgatatttagttgctgattggcttgatcgaaattgaagagcatttcaggtcgggagctaaaatcgacgcactgatttatcaatggtaacgactgacggacttcaggttttaagccaaatttatcgaccagtaaatcattgatgcacggaatggttttatcgtcatttttgtgccagttaatcttttgcccgttactgatttggttattatttaccgcaacgctaacaaaatactcaccgggagcaatgactcctttttcctttaataatgaaatatcaatgcggtcgcgcatcgatttatcgagaacattaaggttgaattcgaccgccaatgcgcaaggcatcgccacgaccaggcaggatacaaaagagagtcgataaatattcacggtgtccatacctgataaatattttatgaaaggcggcgatagcgccgccaaagtaatacttatttataatccagcacgtaggttgcattcgccgtaactgcgcctggcgttacaggtgtagcctgatcaatttgttccatccaggcaaagaaattcagcgtttgttcgctggaggtcggagccaggtcgatatctggagtagcggtgcctaaaacgatattgctttgatctttattcattaaacgtacgccgacgccggtggcttcacccgtgctggtgttgttgagaatcggatctgcgccggtggttttcgctgagctatcaaaggtgactgcaactttagaaatcttgccaccggaaccgttgctggagttttccagatcacagttgactaagcgcaggtcgacagcaacggcatcgctgtgatgtgactgattaatgtggctggtggtcacctgaccgagttcaacctctttatcaatatcatcctgatgtatttcacacggtgcttcaataacttcacctttaaagtgaatttcaccggatccttcatcagccgcataaacaggtgctgtgaacagcagagatacggccagtgcggccaatgttttttgtcctttaaacataacggagtcctttaaataatgagatagaatgttgcgtggcaagaatatattaactggcagttgaatgtatttggttttatttaacaatattaaaaatcttgttatataaagaatggaataattgagtgcataaatttattgtttaatgagatgaaggatggggtgggatggatatgcataattttcattgggttaacaatgctaccagcaggaaagtataaaaataaacttatcattctgctcagtatgtgacttgtcacattttctcaccttattaatgggtatttgtatctggtttaatttttacaatttattatgttcagccatataaaaagaacccgctctattaaaggcgggtccggaaagtaaacggcttagcaatcaatcattaacgcttgatatcgcttttaaagtcgcgtttttcatatcctgtatacagctgacgcggacgggcaatcttcataccgtcactgtgcatttcgctccagtgggcgatccagccaacggtacgtgccattgcgaaaatgacggtgaacatggaagacggaatacccatcgctttcaggatgataccagagtagaaatcgacgttcgggtacagtttcttctcgataaagtacgggtcgttcagcgcgatgttttccagctccatagccacttccagcaggtcatctttggtgcccagctctttcagaacttcatggcaggtttcacgcattacggtggcgcgcgggtcgtaatttttgtacacgcggtgaccgaagcccatcaggcggaaagaatcatttttatctttcgcacgacgaacaaattccggaatgtgtttaacggagctaatttcttccagcattttcagcgccgcttcgttagcaccaccgtgcgcaggtccccacagtgaagcaatacctgctgcgatacaggcaaacgggttcgcacccgaagagccagcggtacgcacggtggaggtagaggcgttctgttcatggtcagcgtgcaggatcagaatacggtccatagcacgttccagaatcggattaacttcatacggttcgcacggcgtggagaacatcatattcaggaagttaccggcataggagagatcgttgcgcggataaacaaatggctgaccaatggaatacttgtaacacatcgcggccatggtcggcattttcgacagcaggcggaacgcggcaatttcacgatgacgaggattgttaacatccagcgagtcgtgatagaacgccgccagcgcgccggtaataccacacatgactgccattggatgtgagtcgcgacggaaagcgtggaacagacgggtaatctgctcgtggatcatggtatgacgggtcaccgtagttttaaattcgtcatactgttcctgagtcggtttttcaccattcagcaggatataacaaacttccaggtagttagaatcggtcgccagctgatcgatcgggaaaccgcggtgcagcaaaataccttcatcaccatcaataaaagtaattttagattcgcaggatgcggttgaagtgaagcctgggtcaaaggtgaacacaccttttgaaccgagagtacggatatcaataacatcttgacccagcgtgcctttcagcacatccagttcaacagctgtgtccccgttgagggtgagttttgcttttgtatcagccatttaaggtctccttagcgccttattacgtaagactgccggaacttaaatttgccttcgcacatcaacctggctttacccgtttgttatttggctcgccgctctgtgaaagaggggaaaacctgggtacagagctctgggcgcttgcaggtaaaggatccattgatgacgaataaatggcgaatcaagtacttagcaatccgaattattaaacttgtctaccactaataactgtcccgaatgaattggtcaatacttccacactgttacataagttaatcttaggtgaaataccgacttcataacttttacgcattatatgcttttcctggtaatgtttgtaacaactttgttgaatgattgtcaaattagatgattaaaaattaaataaatgttgttatcgtgacctggatcactgttcaggataaaacccgacaaactatatgtaggttaattgtaatgattttgtgaacagcctatactgccgccaggtctccggaacaccctgcaatcccgagccacccagcgttgtaacgtgtcgttttcgcatctggaagcagtgttttgcatgacgcgcagttatagaaaggacgctgtctgacccgcaagcagaccggaggaaggaaatcccgacgtctccaggtaacagaaagttaacctctgtgcccgtagtccccagggaataataagaacagcatgtgggcgttattcatgataagaaatgtgaaaaaacaaagacctgttaatctggacctacagaccatccggttccccatcacggcgatagcgtccattctccatcgcgtttccggtgtgatcacctttgttgcagtgggcatcctgctgtggcttctgggtaccagcctctcttcccctgaaggtttcgagcaagcttccgcgattatgggcagcttcttcgtcaaatttatcatgtggggcatccttaccgctctggcgtatcacgtcgtcgtaggtattcgccacatgatgatggattttggctatctggaagaaacattcgaagcgggtaaacgctccgccaaaatctcctttgttattactgtcgtgctttcacttctcgcaggagtcctcgtatggtaagcaacgcctccgcattaggacgcaatggcgtacatgatttcatcctcgttcgcgctaccgctatcgtcctgacgctctacatcatttatatggtcggttttttcgctaccagtggcgagctgacatatgaagtctggatcggtttcttcgcctctgcgttcaccaaagtgttcaccctgctggcgctgttttctatcttgatccatgcctggatcggcatgtggcaggtgttgaccgactacgttaaaccgctggccttgcgcctgatgctgcaactggtgattgtcgttgctctggtggtttacgtgatttatggattcgttgtggtgtggggtgtgtgatgaaattgccagtcagagaatttgatgcagttgtgattggtgccggtggcgcaggtatgcgcgcggcgctgcaaatttcccagagcggtcaaacctgtgcgctgctctctaaagtcttcccgacccgttcccataccgtttctgcgcaaggcggcattaccgttgcgctgggtaatacccatgaagataactgggaatggcatatgtacgacaccgtaaaaggttcggactatatcggtgaccaggacgcgattgaatatatgtgtaaaaccgggccggaagcgattctggaactcgaacacatgggcctgccgttctcgcgtcttgatgatggtcgtatctatcaacgtccgtttggcggtcagtcgaaaaacttcggcggcgagcaggcggcacgcactgcggcagcagctgaccgtaccggtcacgcactgttgcataccctttatcagcagaacctgaaaaaccacaccactattttctccgagtggtatgcgctggatctggtgaaaaaccaggatggcgcggtggtgggttgtactgcactgtgcatcgaaactggtgaagtggtttatttcaaagcccgcgctaccgtgctggcgactggcggggcagggcgtatttatcagtccaccactaacgcccacattaacactggcgacggcgtcggcatggctatccgcgcaggcgtaccggtgcaggatatggaaatgtggcagttccacccgaccggtattgccggtgcgggcgtactggtcaccgaaggttgccgtggtgaaggcggttatctgctgaacaaacatggcgaacgctttatggagcgttatgcgccgaacgccaaagacctggcgggccgtgacgtggtggcgcgttccatcatgattgaaatccgtgaaggtcgcggctgtgatggtccgtgggggccacatgcgaaactgaaactcgaccacctgggtaaagaagttctcgaatcccgtctgccgggtattctggaactctcccgtaccttcgctcacgttgatccggtgaaagagccgattccggttatcccaacctgtcactacatgatgggtggtattccgaccaaagtgaccggtcaggcgctgacggtgaacgagaaaggcgaagatgtggttgttccggggctgtttgccgttggtgaaatcgcttgtgtatcggtacacggcgctaaccgtctgggcggcaactcgctgctggacctggtggtctttggtcgcgcagcgggtctgcatctgcaagagtctatcgccgagcagggcgcattgcgcgatgccagcgagtctgatgttgaagcatctctggatcgtctgaaccgctggaacaataatcgtaacggtgaagatccggtggcgattcgtaaagcgctgcaagaatgtatgcagcataacttctcggtcttccgtgaaggtgatgcgatggcgaaagggcttgagcagttgaaagttatccgcgagcgtctgaaaaatgcccgtctggatgacacttccagcgagttcaacacccagcgcgttgagtgcctggaactggataacctgatggaaacggcgtatgcaacggctgtttctgccaacttccgtaccgaaagccgtggcgcgcatagccgcttcgacttcccggatcgtgatgatgaaaactggctgtgccactccctgtatctgccagagtcggaatccatgacgcgccgaagcgtcaacatggaaccgaaactgcgcccggcattcccgccgaagattcgtacttactaatgcggagacaggaaaatgagactcgagttttcaatttatcgctataacccggatgttgatgatgctccgcgtatgcaggattacaccctggaagcggaagaaggtcgcgacatgatgttgctggatgcgcttatccagctgaaagagaaagatcccagcctgtcgttccgccgctcctgccgtgaaggtgtgtgcggttccgacggtctgaacatgaacggcaagaatggtctggcctgtattaccccgatttcggcactcaaccagccgggcaagaagattgtgattcgcccgctgccaggtttaccggtgatccgcgatttggtggtagacatgggacaattctatgcgcaatatgagaaaattaagccttacctgttgaataatggacaaaatccgccagctcgcgagcatttacagatgccagagcagcgcgaaaaactcgacgggctgtatgaatgtattctctgcgcatgttgttcaacctcttgtccgtctttctggtggaatcccgataagtttatcggcccggcaggcttgttagcggcatatcgtttcctgatcgatagccgtgataccgagactgacagccgcctcgacggtttgagcgatgcattcagtgtattccgctgtcacagcatcatgaactgcgtcagtgtatgtccgaaggggctgaacccgacgcgcgccatcggccatatcaagtcgatgttgttgcaacgtaatgcgtaattaaatgttgatgccggggaaatcccccggctattcaggaaatctttaaaaactgcccctgacactaagacagtttttaaaggttccttcgcgagccactacgtagacaagagctcgcaagtgaaccccggcacgcacatcactgtgcgtggtagtatccacggcgaagtaagcataaaaaagatgcttaagggatcacgatgcagaacagcgctttgaaagcctggttggactcttcttacctctctggcgcaaaccagagctggatagaacagctctatgaagacttcttaaccgatcctgactcggttgacgctaactggcgttcgacgttccagcagttacctggtacgggagtcaaaccggatcaattccactctcaaacgcgtgaatatttccgccgcctggcgaaagacgcttcacgttactcttcaacgatctccgaccctgacaccaatgtgaagcaggtaaaagtcctgcagctcattaacgcataccgcttccgtggtcaccagcatgcgaatctcgatccgctgggactgtggcagcaagataaagtggccgatctggatccgtctttccacgatctgaccgaagcagacttccaggagaccttcaacgtcggttcatttgccagcggcaaagaaaccatgaaactcggcgagctgctggaagccctcaagcaaacctactgcggcccgattggtgccgagtatatgcacatcaccagcaccgaagaaaaacgctggatccaacagcgtatcgagtctggtcgcgcgactttcaatagcgaagagaaaaaacgcttcttaagcgaactgaccgccgctgaaggccttgaacgttacctcggcgcaaaattccctggcgcaaaacgcttctcgctggaaggcggtgacgcgttaatcccgatgcttaaagagatgatccgccacgctggcaacagcggcacccgcgaagtggttctcgggatggcgcaccgtggtcgtctgaacgtgctggtgaacgtgctgggtaaaaaaccgcaagacttgttcgacgagttcgccggtaaacataaagaacacctcggcacgggtgacgtgaaataccacatgggcttctcgtctgacttccagaccgatggcggcctggtgcacctggcgctggcgtttaacccgtctcaccttgagattgtaagcccggtagttatcggttctgttcgtgcccgtctggacagacttgatgagccgagcagcaacaaagtgctgccaatcaccatccacggtgacgccgcagtgaccgggcagggtgtggttcaggaaactctgaacatgtcgaaagcgcgtggttatgaagttggcggtacggtacgtatcgttatcaacaaccaggttggtttcaccacctctaatccgctggatgctcgttctacaccgtactgtactgatatcggtaagatggttcaggcaccgattttccacgttaacgcggatgatccggaagccgttgcctttgtgacccgtctggcgctcgatttccgtaacacctttaaacgtgatgtcttcatcgacctggtgtgctaccgccgtcacggccacaacgaagccgacgagccgagcgcaacccagccgctgatgtatcagaaaatcaaaaaacatccgacgccgcgcaaaatctatgctgacaagctggagcaggaaaaagtggcgacgctggaagatgccaccgagatggttaacctgtaccgcgatgcgctggatgctggcgattgcgtagtggcagagtggcgtccgatgaacatgcactctttcacctggtcgccgtatctcaaccacgaatgggacgaagagtacccgaacaaagttgagatgaagcgcctgcaggaactggctaaacgcatcagcacggtgccggaagcggttgaaatgcagtctcgcgttgccaaaatttatggcgatcgccaggcgatggctgccggtgagaaactgttcgactggggaggcgcggaaaacctcgcttacgccacgctggttgacgaaggcattccggttcgcctgtcgggtgaagactccggtcgcggtaccttcttccaccgccacgcggtgatccacaaccagtctaacggttccacttacacgccgctgcaacacatccataacggccagggcgcgttccgtgtctgggactccgtactgtctgaagaagcagtgctggcgtttgaatacggttatgccaccgcagaaccacgcactctgactatctgggaagcgcagttcggtgacttcgccaacggtgcgcaggtggttatcgaccagttcatctcctctggcgaacagaaatggggccggatgtgtggtctggtgatgttgctgccgcacggttatgaagggcaggggccggagcactcctccgcgcgtctggaacgttatctgcaactttgtgctgagcaaaacatgcaggtgtgcgtaccgtctaccccggcacaggtttaccacatgctgcgtcgtcaggcgctgcgcgggatgcgtcgtccgctggtcgtgatgtcgccgaaatccctgctgcgtcatccgctggcggtttccagcctcgaagaactggcgaacggcaccttcctgccagccatcggtgaaatcgacgagcttgatccgaagggtgtgaagcgcgtagtgatgtgttctggtaaggtttattacgacctgctggaacaacgtcgtaagaacaatcaacacgatgtcgccattgtgcgtatcgagcaactctacccgttcccgcataaagcgatgcaggaagtgttgcagcagtttgctcacgtcaaggattttgtctggtgccaggaagagccgctcaaccagggcgcatggtactgcagccagcatcatttccgtgaagtgattccgtttggggcttctctgcgttatgcaggccgcccggcctccgcctctccggcggtagggtatatgtccgttcaccagaaacagcaacaagatctggttaatgacgcgctgaacgtcgaataaataaaggatacacaatgagtagcgtagatattctggtccctgacctgcctgaatccgtagccgatgccaccgtcgcaacctggcataaaaaacccggcgacgcagtcgtacgtgatgaagtgctggtagaaatcgaaactgacaaagtggtactggaagtaccggcatcagcagacggcattctggatgcggttctggaagatgaaggtacaacggtaacgtctcgtcagatccttggtcgcctgcgtgaaggcaacagcaccggtaaagaaaccagcgccaaatctgaagagaaagcgtccactccggcgcaacgccagcaggcgtctctggaagagcaaaacaacgatgcgttaagcccggcgatccgtcgcctgctggctgaacacaatctcgacgccagcgccattaaaggcaccggtgtgggtggtcgtctgactcgtgaagatgtggaaaaacatctggcgaaagccccggcgaaagagtctgctccggcagcggctgctccggcggcgcaaccggctctggctgcacgtagtgaaaaacgtgtcccgatgactcgcctgcgtaagcgtgtggcagagcgtctgctggaagcgaaaaactccaccgccatgctgaccacgttcaacgaagtcaacatgaagccgattatggatctgcgtaagcagtacggtgaagcgtttgaaaaacgccacggcatccgtctgggctttatgtccttctacgtgaaagcggtggttgaagccctgaaacgttacccggaagtgaacgcttctatcgacggcgatgacgtggtttaccacaactatttcgacgtcagcatggcggtttctacgccgcgcggcctggtgacgccggttctgcgtgatgtcgataccctcggcatggcagacatcgagaagaaaatcaaagagctggcagtcaaaggccgtgacggcaagctgaccgttgaagatctgaccggtggtaacttcaccatcaccaacggtggtgtgttcggttccctgatgtctacgccgatcatcaacccgccgcagagcgcaattctgggtatgcacgctatcaaagatcgtccgatggcggtgaatggtcaggttgagatcctgccgatgatgtacctggcgctgtcctacgatcaccgtctgatcgatggtcgcgaatccgtgggcttcctggtaacgatcaaagagttgctggaagatccgacgcgtctgctgctggacgtgtagtagtttaagtttcacctgcactgtagaccggataaggcattatcgccttctccggcaattgaagcctgatgcgacgctgacgcgtcttatcaggcctacgggaccaccaatgtaggtcggataaggcgctagcgccgcatccgacaagcgatgcctgatgtgacggttaacgtgtcttatcaggcctacggggaccaccaatgtaggtcggataaggcgcaagcgccgcatccgacaagcgatgcctgatgtgacgtttaacgtgtctcatcaggcctacgggtgaccgacaatgcccggaagcgatacgaaatattcggtctacggtttaaaagataacgattactgaaggatggacagaacacatgaacttacatgaatatcaggcaaaacaactttttgcccgctatggcttaccagcaccggtgggttatgcctgtactactccgcgcgaagcagaagaagccgcttcaaaaatcggtgccggtccgtgggtagtgaaatgtcaggttcacgctggtggccgcggtaaagcgggcggtgtgaaagttgtaaacagcaaagaagacatccgtgcttttgcagaaaactggctgggcaagcgtctggtaacgtatcaaacagatgccaatggccaaccggttaaccagattctggttgaagcagcgaccgatatcgctaaagagctgtatctcggtgccgttgttgaccgtagttcccgtcgtgtggtctttatggcctccaccgaaggcggcgtggaaatcgaaaaagtggcggaagaaactccgcacctgatccataaagttgcgcttgatccgctgactggcccgatgccgtatcagggacgcgagctggcgttcaaactgggtctggaaggtaaactggttcagcagttcaccaaaatcttcatgggcctggcgaccattttcctggagcgcgacctggcgttgatcgaaatcaacccgctggtcatcaccaaacagggcgatctgatttgcctcgacggcaaactgggcgctgacggcaacgcactgttccgccagcctgatctgcgcgaaatgcgtgaccagtcgcaggaagatccgcgtgaagcacaggctgcacagtgggaactgaactacgttgcgctggacggtaacatcggttgtatggttaacggcgcaggtctggcgatgggtacgatggacatcgttaaactgcacggcggcgaaccggctaacttccttgacgttggcggcggcgcaaccaaagaacgtgtaaccgaagcgttcaaaatcatcctctctgacgacaaagtgaaagccgttctggttaacatcttcggcggtatcgttcgttgcgacctgatcgctgacggtatcatcggcgcggtagcagaagtgggtgttaacgtaccggtcgtggtacgtctggaaggtaacaacgccgaactcggcgcgaagaaactggctgacagcggcctgaatattattgcagcaaaaggtctgacggatgcagctcagcaggttgttgccgcagtggaggggaaataatgtccattttaatcgataaaaacaccaaggttatctgccagggctttaccggtagccaggggactttccactcagaacaggccattgcatacggcactaaaatggttggtggcgtaactccaggtaaaggcggcactacccacctcggcctgccggtgttcaacaccgtgcgtgaagctgttgctgctactggcgctaccgcttctgttatctacgtaccagcaccgttctgcaaagactccattctggaagccatcgacgcaggcatcaaactgattatcaccatcactgaaggcatcccgacgctggatatgctgactgtgaaagtgaaactggacgaagcaggcgttcgtatgatcggcccgaactgcccaggcgttatcactccgggtgaatgcaaaatcggtatccagccgggtcacattcacaaaccgggtaaagtgggtatcgtttcccgttccggtacactgacctatgaagcggttaaacagaccacggattacggtttcggtcagtcgacctgtgtcggtatcggcggtgacccgatccctggctctaactttatcgacattctcgaaatgttcgaaaaagatccgcagaccgaagcgatcgtgatgattggtgagatcggcggtagcgctgaagaagaagcggcagcgtacatcaaagagcacgttaccaagccagttgtgggctacattgctggtgtgactgcgccgaaaggcaaacgtatgggccacgcgggtgccatcattgccggtgggaaagggactgcggatgagaaattcgctgctctggaagccgcaggcgtgaaaaccgttcgcagcctggcggatatcggtgaagcactgaaaactgttctgaaataaatatctgtaataagaaatagccctcgccgcttccctctacaggaatggcgaagggctgtcggtttcgacatggttggccatcgtatgatggccttttttgtgcttatcgcgatgattttcgctgcgctatcagggtaaatttatagtcatcggtattaaaagcgttgcggctatattcaaacacccgaccatcaactaaatatccacgcgatactttttcaagaatcggctttgtctggctgatattaagcagacggctcatctcttcggttggcatcagaggaatgatttcctgttcgctacgctcgataaccattttcttcacttcttcaataaagtgatatttcgaattttccatgacctgccaggtgagatccgggaacaacgcaagcggcatccaggtttcttccagcgccattggcttttgcttgcgatagcgcacgcgcttcacatgccacacacgatcctgcgcggtgatttgtagctgttgctgaagaaaatcgtcagccggaatcacttcaaatatcaggacttcactgtgtgtatcgacgtgacggtccgacagtttttcatcaaaactggttaactgaaaaatatcgtaattgacccgctcttctttgacgtaagtcccgctgccctgaatgctttcgaggatctgctgctcgactagctggcgcaaagcctgacgcaccgtaacccggctgacgccaaactctgtttgtaatgcagattcggtaggtaacgcatcgccaggtttaagctccccacgcgcaatttgctcacgaatgcgatcggcaatctgccggtataagggtttgtgtcccatttttagtatctcattaatacgaatttagccattatgcccgataaattcatcctgtaaataatacaaatacaatacaaataatttcaatcaagtgaaattgatcacataatggtattgttttatcgggcacgctggcgcgactataaaaacgatcaagtgaggatcatgatgaatctgacgactctgacccaccgcgatgcgttgtgtctgaatgcgcgctttaccagccgtgaagaggccatccacgtgttgactcaacgtcttgctgctctggggaaaatttccagtactgagcaatttctggaagaagtgtatcgccgtgaaagccttggcccgaccgccttaggtgaagggttggctgtgccgcatggcaaaactgctgcggtaaaagaagcggcgtttgcggtcgccacactcagcgagccgcttcagtgggaaggcgttgatggcccggaagcagttgatttagtggtgctgctggcgattccccccaatgaagcgggtactacgcatatgcaactgctgacagcgctgaccacgcgccttgcggatgatgagattcgggcgcgtatacagtcggcgacgacgcctgatgagttgctctcggcgctggatgacaagggaggcacgcaaccttctgcctctttttccaacgcgccaactatcgtctgcgtaacggcctgtccggcgggtattgctcacacctatatggctgcggaatatctggaaaaagccggacgcaaactcggcgtaaatgtttacgttgaaaaacaaggcgctaacggcattgaagggcgtttaacggcggatcaactcaatagtgcaaccgcctgtatttttgcggctgaagtcgccatcaaggagagtgagcgttttaatggcattcccgcgctttcagtgcctgttgccgagccgattcgccatgcagaagcgttgatccaacaagcgcttaccctcaagcgtagcgatgagacgcgtaccgtacagcaagatacgcaaccggtgaaaagtgtcaaaacggagctgaaacaggcactgttgagcggaatctcttttgccgtaccgttgattgtcgcggggggcacggtgctggcggtcgcggtattactgtcgcaaatcttcgggctacaagatctgtttaatgaagaaaactcctggctgtggatgtaccgcaagctgggcggcgggctgctcggaattttgatggtaccggtgctcgcggcctataccgcctattctctggcagataaaccggcgttagcgccaggctttgcggctggacttgccgccaacatgatcggctccgggtttctcggcgcggtcgttggcggattgatagccggttacttgatgcgctgggtgaaaaatcacttgcgtcttagcagtaaattcaatggattcctgactttttatctctacccggtgctcggtacgttgggagcgggcagtctgatgctgtttgtggtgggggaacctgtcgcctggatcaataactcgcttaccgcctggctgaacggtctgtcaggaagtaacgcgctgttgctgggtgccattctcggttttatgtgttcctttgaccttggagggccagtgaataaagccgcttatgcattctgcctgggcgcaatggcgaacggcgtttacggcccgtatgccattttcgcctccgtcaaaatggtttcggcatttaccgtaaccgcttccacgatgctcgcaccgcgcctgtttaaagagtttgaaattgagaccgggaaatccacctggctgttagggctggcaggtattaccgaaggggcgatcccgatggcgattgaagatccgctgcgggttattggttcgtttgtgctgggctctatggtaacgggcgctattgtcggtgcgatgaatatcggcctttcgacacccggtgccggcattttctcgctctttttacttcatgataatggcgcgggcggtgttatggcggcaattggctggtttggcgcggcattggtgggggctgcaatctcgactgcaattctcctgatgtggcggcgtcacgcggttaagcatggcaactatctgactgatggcgtaatgccataaacaaaaaggaaacgacgatgaaagcagtatctcgcgttcacatcaccccgcatatgcactgggatcgagagtggtatttcaccaccgaagagtcacgtattctgctggtcaataatatggaagagatcctgtgccgactggaacaggacaacgaatacaaatattacgtactcgacgggcaaacggcgatcctcgaagattatttcgcggtgaaaccggaaaacaaagaccgtgtgaagaaacaggtagaagccggcaagttgattatcggcccctggtatacccagaccgataccacgattgtttctgcggaatccatcgtccgtaatctgatgtacggaatgcgtgactgcctcgcgtttggcgagccgggtaatgactccaacttattgatagtgttttatgttcagataatgcccgatgactttgtcatgcagctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgctcaccgaatacgtgcgcaacaaccgtcttccggagactgtcatacgcgtaaaacagccagcgctggcgcgatttagccccgacatagccccactgttcgtccatttccgcgcagacgatgacgtcactgcccggctgtatgcgcgaggttaccgactgcggcctgagttttttaagtgacgtaaaatcgtgttgaggccaacgcccataatgcgggcagttgcccggcatccaacgccattcatggccatatcaatgattttctggtgcgtaccgggttgagaagcggtgtaagtgaactgcagttgccatgttttacggcagtgagagcagagatagcgctgatgtccggcggtgcttttgccgttacgcaccaccccgtcagtagctgaacaggagggacagctgatagaaacagaagccactggagcacctcaaaaacaccatcatacactaaatcagtaagttggcagcatcaccggcgagccgatgaaaataggttatttaccagattcctttggcatgtccgggcaactgccgcatatctacaatggatttggcattacccgcaccatgttctggcgcggatgttcggagcgccacggtactgataaaaccgagtttttgtggcaaagcagtgacggtagcgaagtgacggcgcaggtgctgccgctgggctacgccatcggtaagtacttacctgccgacgaaaacggattacgtaaacgcctcgacagttattttgacgtgctggaaaaagcgtctgtaaccaaagagattttgctgccgaatgggcatgaccagatgccattgcagcaaaatatcttcgaagtgatggataagctacgtgagatctaccctcaacgtaagtttgtgatgagccgctttgaagaggtatttgagaagatcgaagcgcagcgagataatctggcaaccctgaaaggggaatttattgatggcaaatatatgcgcgtgcatcgcaccatcggttctacgcgtatggatatcaaaattgcccacgcgcgtattgaaaataagattgttaatctgctggaaccgctggcaacgctggcctggacgttgggttttgaataccaccacggcttgctggagaaaatgtggaaagagatcttaaaaaatcatgcccacgacagtatcggttgttgttgcagtgacaaagttcatcgcgaaattgtcgcccgcttcgaactggctgaagacatggcggataatctgctgcgtttctacatgcgcaaaattgccgataacatgccacagagtgatgccgacaaactcgtgctgtttaacctgatgccctggccgcgggaagaagttattaacaccactgtgcggctgcgcgccagccagtttaatctacgagacgatcgcggtcagtctgtaccgtattttattcgccatgcccgtgagatcgatcctggcctaatcgatcggcaaattgttcattatggcaattatgatccctttatggagtttgatattcagatcaaccagattgtcccttctatgggctatcgcacgctttatattgaagcgaatcagcctggcaacgtgattgcggcaaaaagtgacgctgaagggatactggaaaatgctttctggcaaattgcgctcaatgaggatggttctctgcaactggtagataaagacagcggtgtgcgctatgaccgggtattgcaaattgaagaaagctctgatgatggtgatgaatatgactattcacccgcaaaagaagagtgggtaattaccgcagcgaacgcgaaaccgcaatgcgatattattcatgaagcctggcagagcagggctgttatccgctatgacatggcagtgccgctcaatttgtcagaacgcagcgcccggcaatccactggcagagtagggggggtgttggttgtcactcttagtcataacagcaggcgtattgatgtggatatcaaccttgataaccaggctgacgatcatcgccttcgtgtcctggtccctacaccttttaacaccgacagtgttctggcagatacgcagtttggttcgctaacgcgccccgtgaacgacagtgcaatgaacaactggcagcaagaaggctggaaagaagcgccggttccggtatggaatatgctcaactatgttgccttacaggaagggcgtaacggcatggctgtctttagcgaagggttacgtgaatttgaagtcatcggtgaagagaagaaaacctttgccattacgttgctgcgtggcgtgggcttactgggcaaagaagatctgcttttaaggcctgggcggccttcgggaattaaaatgccagtcccggactcacaactacgtggtctgctttcttgtcgcctaagtttattgagttataccggtacgccaaccgccgctggtgtagctcagcaggcgcgagcatggctgactccagtacagtgttacaacaaaatcccatgggatgcgatgaagctcaacaaagccggattcaacgtgccggaaagttatagtttgttgaaaatgcccccagtgggatgcctgataagcgcacttaagaaagctgaagaccgacaagaagtgattttacggctgtttaatccggctgaatcagcaacctgtgatgcgactgttgctttcagtcgcgaggtgatttcttgctcagaaacgatgatggatgaacacattaccaccgaggaaaatcaaggttcaaatctatcggggccttttttacccggccagtcacggacgttcagttaccggcttgcctgaatagcaatcaaaccgaagccacatatgcgcggccagattgttgacaaagggcgctttgttcatgccggatacggcatgaacgctttattcggtctacaaaagcaggcaaattcaatatattgcagagatgatgtagacactggcaagcgtagcgcatcaggtaattttgcgtttatcttcactctcaagccacgtatatgtggctttatttttaacaaaataataaccctgggtgagttaattataatataattataagttaattaaatgttaatattggcggggtggatttatgcctttattagtaatcctgaaactctgcgtcgtattagccagtgaccaaaaaaagaattaaggtcaaccgtgctgtttttgcttcgtctctttttatctttaattgccaaccgaaactaatttcagccttataactcacacattttaaacataaatgtcactaaagttaccttattgaaacatgattaacataatttgtaggaattgatatttatcaatgtataagtcttggaaatgggcatcaaaaagagataaattgttctcgatcaaattggctgaaaggcggtaatttagctataaattgatcaccgtcgaaaaatgcaaatttgcttcaacaaaaacctgtttattgtaaggattttgcggcgtaatatatacgtgggatcaatttgagtttttattaacatgtttgcaacctttctttacgccgtttttgtgtgcattcacatggtatgatgaaagtgttcaaacaaatttctattggggcatgcgtgtgaccctttctaacggggttcactctcggagtcttcatgcgatgagcaaggagtcatgatgttagatatagtcgaactgtcgcgcttacagtttgccttgaccgcgatgtaccacttcctttttgtgccactgacgctcggtatggcgttcctgctggccattatggaaacggtctacgtcctctccggcaaacagatttataaagatatgaccaagttctggggcaagttgtttggtatcaacttcgctctgggtgtggctaccggtctgaccatggagttccagttcgggactaactggtcttactattcccactatgtaggggatatcttcggtgcgccgctggcaatcgaaggtctgatggccttcttcctcgaatccacctttgtaggtctgttcttcttcggttgggatcgtctgggtaaagttcagcatatgtgtgtcacctggctggtggcgctcggttcaaacctgtccgcactgtggattctggttgcgaacggctggatgcaaaacccaatcgcgtccgatttcaactttgaaactatgcgtatggagatggtgagcttctccgagctggtgcttaacccggttgctcaggtgaaattcgttcacactgtagcgtctggttatgtgactggcgcgatgttcatcctcggtatcagcgcatggtatatgctgaaaggtcgtgacttcgccttcgctaaacgctcctttgctatcgctgccagcttcggtatggctgctgttctgtctgttattgttctgggtgatgaatccggctacgaaatgggcgacgtgcagaaaaccaaactggctgctattgaagccgagtgggaaacgcaacctgcgcctgctgcctttactctgttcggcattcctgatcaggaagaggagacgaacaaatttgcgattcagatcccttacgcactgggcatcattgcaacgcgttccgtggataccccggttatcggcctgaaagagctgatggtgcagcatgaagaacgcattcgtaacgggatgaaggcgtactctctgctcgaacaactgcgttctggttctaccgaccaggcggttcgtgaccagttcaatagcatgaagaaagacctcggttacggtctgctgctgaaacgctatacgccaaacgtggctgatgcgactgaagcgcagattcaacaggcaaccaaagactccatcccgcgtgtagcgccgctgtactttgcgttccgtatcatggtggcgtgtggcttcctgcttctggcaatcatcgcgctctctttctggagtgtcatccgcaaccgcattggcgagaaaaaatggcttctgcgcgccgcgctgtacggtattccgctgccgtggattgctgtagaagcgggctggttcgtggctgaatatggccgccaaccgtgggctatcggtgaagtgctgccgacagctgtggcgaactcgtcactgaccgcaggcgatctcatcttctcaatggtgctgatttgcggcctgtataccctgttcctggtggcagaattgttcttaatgttcaagtttgcacgcctcggcccaagcagcctgaaaaccggtcgctatcactttgagcagtcttccacgactactcagccggcacgctaagacaggagtcgtcaaatgatcgattatgaagtattgcgttttatctggtggctgctggttggcgttctgctgattggttttgcagtcactgacggtttcgacatgggggtgggcatgctcacccgtttcctcggtcgtaacgacaccgagcgtcgaattatgattaactccattgcaccacactgggacggtaaccaggtttggctgatcaccgcgggcggcgcactctttgctgcctggccgatggtctatgccgctgcgttctccggcttctatgtggcgatgatcctcgtgctggcgtctttgttcttccgtccggtcggttttgactaccgctccaagattgaagaaacccgctggcgtaacatgtgggactggggcatcttcattggtagcttcgttccgccgctggtaattggtgtagcgttcggtaacctgttgcagggcgtaccgttcaacgttgatgaatatctgcgtctgtactacactggtaacttcttccagttgcttaacccgttcggcctgctggcaggcgtggtgagcgtagggatgatcattactcagggcgcaacctatctgcaaatgcgtaccgtgggcgaactgcacctgcgtacccgtgcaacggctcaggtggctgcgctggtgacactggtctgtttcgcactggctggcgtatgggtgatgtacggtatcgatggttatgtcgtgaaatcgacaatggaccattacgcagcctctaacccactgaataaagaagtggttcgtgaagctggcgcatggctggttaacttcaacaacacgccaattctgtgggctattccggcactgggtgtggttctgccgctgctgaccatcctgactgcacgtatggataaagccgcgtgggcgtttgtgttctcctccctgacgctggcctgcatcatcctgacagccggtatcgcaatgttcccgtttgtgatgccgtccagcaccatgatgaacgcaagtctgacaatgtgggatgcaacttccagccagctgacgcttaacgtcatgacctgggttgcggtggttctggtaccgatcattctgctctacaccgcctggtgttactggaaaatgttcggtcgtatcaccaaagaagatattgaacgtaacacccactctctgtactaagtaaggagctaaaaatgtggtatttcgcatggattctgggaacgcttcttgcctgttcgtttggggtaatcaccgcgctggcgcttgaacacgtcgaatcaggcaaagccggtcaagaagacatctgatgagtaagattatcgcgactttgtatgcggtaatggacaagcgccccctgcgggcgctttccttcgtgatggcgcttctgttagcaggatgtatgttttgggacccatctcgttttgccgcgaagaccagtgaactggaaatctggcatggtttattgctgatgtgggccgtctgtgctggtgtgattcacggcgtgggctttcgtccgcagaaggttctttggcaagggattttttgcccattgcttgccgatattgttctcattgtcgggctgattttcttcttcttttaaatcagaattctctttaaaaaattatgggccgctccaggcccataaatttttacgctcccttaacttgccctcattcccaaacctcaatcgcgcgcgtatagtagcagcgtttaaaagctctaacttttgttgcattaccgggatgtaaagtgaatacaacgctgtttcgatggccggttcgcgtctactatgaagataccgatgccggtggtgtggtgtaccacgccagttacgtcgctttttatgaaagagcacgcacagagatgctgcgtcatcatcacttcagtcagcaggcgctgatggctgaacgcgttgcctttgtggtacgtaaaatgacggtggaatattacgcacctgcgcggctcgacgatatgctcgaaatacagactgaaataacatcaatgcgtggcacctctttggttttcacgcaacgtattgtcaacgccgagaatactttgctgaatgaagcagaggttctggttgtttgcgttgacccactcaaaatgaagcctcgtgcgcttcccaagtctattgtcgcggagtttaagcagtgactgacatgaatatccttgatttgttcctgaaggctagccttctggttaaacttatcatgttgattttgattggtttttcaatcgcatcttgggccattattatccagcggacccgtattcttaacgcagcggcgcgcgaagccgaagcgtttgaagataaattctggtctggaatcgaactctctcgcctctatcaagagagccaggggaaacgggataatctgactggttcggaacaaatcttttacagcgggttcaaagagtttgtgcgcctgcatcgtgccaatagccatgcgccggaagccgtagtggaaggggcgtcgcgtgctatgcgtatctccatgaaccgtgaacttgaaaatctggaaacgcacattccgttcctcggtacggttggctccatcagcccgtatattggtctgtttggtacggtctgggggatcatgcacgcctttatcgccctcggggcggtaaaacaagcaacactgcaaatggttgcgcccggtatcgcagaagcgttgattgcgactgcaattggtctgtttgccgctatcccggcagttatggcctacaaccgcctcaaccagcgcgtaaacaaactggaactgaattacgacaactttatggaagagtttaccgcgattctgcaccgccaggcgtttaccgttagcgagagcaacaaggggtaagccatggccagagcgcgtggacgaggtcgtcgcgatctcaagtccgaaatcaacattgtaccgttgctggacgtactgctggtgctgttgctgatctttatggcgacagcgcccatcatcacccagagcgtggaggtcgatctgccagacgctactgaatcacaggcggtgagcagtaacgataatccgccagtgattgttgaagtgtctggtattggtcagtacaccgtggtgtttgagaaagatcgcctggagcgtttaccaccagagcaggtggtggcggaagtgtccagccgtttcaaggccaacccgaaaacggtctttctgatcggtggcgcaaaagatgtgccttacgatgaaataattaaagcactgaacttgttacatagtgcgggtgtgaaatcggttggtttaatgacgcagcctatctaaacatctgcgtttcccttgcttgaaagagagcgggtaacaggcgaacagtttttggaaaccgagagtgtcaaaggcaaccgaacaaaacgacaagctcaagcgggcgataattatttcagcagtgctgcatgtcatcttatttgcggcgctgatctggagttcgttcgatgagaatatagaagcttcagccggaggcggcggtggttcgtccatcgacgctgtcatggttgattcaggtgcggtagttgagcagtacaaacgcatgcaaagccaggaatcaagcgcgaagcgttctgatgaacagcgcaagatgaaggaacagcaggctgctgaagaactgcgtgagaaacaagcggctgaacaggaacgcctgaagcaacttgagaaagagcggttagcggctcaggagcagaaaaagcaggctgaagaagccgcaaaacaggccgagttaaagcagaagcaagctgaagaggcggcagcgaaagcggcggcagatgctaaagcgaaggccgaagcagatgctaaagctgcggaagaagcagcgaagaaagcggctgcagacgcaaagaaaaaagcagaagcagaagccgccaaagccgcagccgaagcgcagaaaaaagccgaggcagccgctgcggcactgaagaagaaagcggaagcggcagaagcagctgcagctgaagcaagaaagaaagcggcaactgaagctgctgaaaaagccaaagcagaagctgagaagaaagcggctgctgaaaaggctgcagctgataagaaagcggcagcagagaaagctgcagccgacaaaaaagcagcagaaaaagcggctgctgaaaaggcagcagctgataagaaagcagcggcagaaaaagccgccgcagacaaaaaagcggcagcggcaaaagctgcagctgaaaaagccgctgcagcaaaagcggccgcagaggcagatgatattttcggtgagctaagctctggtaagaatgcaccgaaaacggggggaggggcgaaagggaacaatgcttcgcctgccgggagtggtaatactaaaaacaatggcgcatcaggggccgatatcaataactatgccgggcagattaaatctgctatcgaaagtaagttctatgacgcatcgtcctatgcaggcaaaacctgtacgctgcgcataaaactggcacccgatggtatgttactggatatcaaacctgaaggtggcgatcccgcactttgtcaggctgcgttggcagcagctaaacttgcgaagatcccgaaaccaccaagccaggcagtatatgaagtgttcaaaaacgcgccattggacttcaaaccgtaatcgcgatgttgactgttcggacggtcaacatcaggcaccggttgccacggggttctggtagttttgtgtattttagtttgttaacattctgctaaattatcgtgggccatcggtccagataagggagatatgatgaagcaggcattacgagtagcatttggttttctcatactgtgggcatcagttctgcatgctgaagtccgcattgtgatcgacagcggtgtagattccggtcgtcctattggtgttgttcctttccagtgggcggggcctggtgcggcacctgaagatattggcggcatcgttgctgctgacttgcgtaacagcggtaaatttaatccgttagatcgcgctcgtctgccacagcagccgggtagtgcgcaggaagtacaaccagctgcatggtccgcactgggcattgacgctgtagttgtcggtcaggtcactccgaatccggatggttcttacaatgttgcttatcaacttgttgacactggcggcgcaccgggtactgtacttgctcagaactcgtacaaagtgaacaagcagtggctgcgttatgctggtcataccgccagtgatgaagtgtttgaaaaactgaccggcattaaaggtgcgttccgtactcgtattgcctacgttgttcagaccaacggcggtcagttcccgtatgaactgcgcgtatctgactatgacggttacaaccagtttgtcgttcaccgttcaccgcagccgctgatgtctccggcgtggtcaccagacggttctaaactggcttatgtgaccttcgaaagcggtcgttccgcgctggttattcagacgctggcaaatggcgctgtacgtcaggtggcttcattcccgcgtcacaacggtgcacctgcattctcgccagacggcagcaaactggcattcgccttgtcgaaaaccggtagtctgaacctgtacgtaatggatttggcttctggtcagatccgccaggtgactgatggtcgcagtaacaataccgaaccgacctggttcccggatagccagaacctggcatttacttctgaccaggccggtcgtccgcaggtttataaagtgaatatcaacggcggtgcgccacaacgtattacctgggaaggttcgcagaaccaggatgcggatgtcagcagcgacggtaaatttatggtaatggtcagctcccaatggtgggcagcagcacattgccaaacaagatctggcaacgggaggcgtacaagttctgtcgtccacgttcctggatgaaacgccaagtctggcacctaacggcactatggtaatctacagctcttctcaggggatgggatccgtgctgaatttggtttctacagatgggcgtttcaaagcgcgtcttccggcaactgatggacaggtcaaattccctgcctggtcgccgtatctgtgataataattaattgaatagtaaaggaatcattgaaatgcaactgaacaaagtgctgaaagggctgatgattgctctgcctgttatggcaattgcggcatgttcttccaacaagaacgccagcaatgacggcagcgaaggcatgctgggtgccggcactggtatggatgcgaacggcggcaacggcaacatgtcttccgaagagcaggctcgtctgcaaatgcaacagctgcagcagaacaacatcgtttacttcgatctggacaagtacgatatccgttctgacttcgctcaaatgctggatgcacatgcaaacttcctgcgtagcaacccgtcttacaaagtcaccgtagaaggtcacgcggacgaacgtggtactccggaatacaacatctccctgggtgaacgtcgtgcgaacgccgttaagatgtacctgcagggtaaaggcgtttctgcagaccagatctccatcgtttcttacggtaaagaaaaacctgcagtactgggtcatgacgaagcggcatactccaaaaaccgtcgtgcggtactggtttactaagagaattgcatgagcagtaacttcagacatcaactattgagtctgtcgttactggttggtatagcggccccctgggccgcttttgctcaggcaccaatcagtagtgtcggctcaggctcggtcgaagaccgcgtcactcaacttgagcgtatttctaatgctcacagccagcttttaacccaactccagcaacaactttctgataatcaatccgatattgattccctgcgtggtcagattcaggaaaatcagtatcaactgaatcaggtcgtggagcggcaaaagcagatcctgttgcagatcgacagcctcagcagcggtggtgcagcggcgcaatcaaccagcagcgatcaaagcggtgcggcggcatcaacgacgccgacagctgatgctggtactgcgaatgctggcgcgccggtgaaaagcggcgatgcaaacacggattacaatgcagctattgcgctggtgcaggataaatcccgccaggatgacgcaatggtggcatttcagaatttcatcaaaaattaccctgattcaacttacctgccaaacgccaattattggctgggtcagttaaactacaacaagggtaaaaaagatgatgcggcgtactattttgcttcggtagtgaaaaactatccgaagtcaccaaaggctgctgatgcgatgtttaaagtcggcgtcatcatgcaggacaaaggtgacaccgcaaaagcgaaagccgtataccagcaggttatcagtaaataccctggtactgatggcgctaaacaggcacaaaaacgtctgaacgcgatgtaatgcataacacacgaccagaagtcgcattatttctggtcgtgtcgtgcgaatcataagcagttgagtgatctgcatcgaaatttttgttgcgctcaagtctgaaatcagtaatatatgccgccgttgccacgggatatcaaacaaaccgaaagcaacgaaaaagtgggtcgttagctcagttggtagagcagttgacttttaatcaattggtcgcaggttcgaatcctgcacgacccaccaatcgctaaggtggaagcggtagtaaaacgtgaaggataatgttgcatcagcaacggcccgaagggcgagacgaagtcgagtcatcctgcacgacccaccactaacatagttagttgtagtatccagcgtagtattgggtgattagctcagctgggagagcacctcccttacaaggagggggtcggcggttcgatcccgtcatcacccaccaccgggtcgttagctcagttggtagagcagttgacttttaatcaattggtcgcaggttcgaatcctgcacgacccaccactaattacggtgggttcggtggaagtagtttgtagtatccagcgcagtatcgggtgattagctcagctgggagagcacctcccttacaaggagggggtcggcggttcgatcccgtcatcacccaccactcgggtcgttagctcagttggtagagcagttgacttttaatcaattggtcgcaggttcgaatcctgcacgacccaccagttttaacatcaaactcagatgttaagcgtgaaggataacgttacgccagcaacggcccgtagggcgagcgaagcgagtcatcctgcacgagccaccaattttaaagattggtttcgagtagaaatctttcaggtaacacccatatgggtcgttagctcagttggtagagcagttgacttttaatcaattggtcgcaggttcgaatcctgcacgacccaccaatttaaaggtggttactggtagagaacgtgaaggataacgttgcgttagcaacggcccgaagggcgagacgaagtccagtcatcctgcacgacccaccatcctgaatgattaaagcagcataatcccgcaaggggtcgttagctcagttggtagagcagttgacttttaatcaattggtcgcaggttcgaatcctgcacgacccaccaatgtaaaaaagcgccctaaaggcgcttttttgctattcaggcatctctcaatttcaattcttgaccctgatgacatactccgcgcttgctgcgtaaacaactttacgtcggaggaataagacgcaaagtgtggcattcggcatctcatacgtaattcgagtgacttttccccaccattcgactatcttgtttagcatataaaacaaattacaccgataacagcgaatattacgctaatgtcggttttaacgttaagcctgtaaaacgagatggtaagatgagcgtaatgtttgatccagacacggcgatttatcctttccccccgaagccgacgccgttaagcattgatgaaaaagcgtattaccgcgagaagataaaacgtctgctaaaagaacgtaatgcggtgatggttgcccactactataccgatcccgaaattcaacaactggcagaagaaaccggtggctgtatttctgattctctggaaatggcgcgcttcggtgcaaagcatcccgcttctactttgttagtcgctggggtgagatttatgggagaaaccgccaaaattctcagtccggaaaaaacaattctgatgccgacacttcaggctgaatgttcactggatctcggctgccctgttgaagaatttaacgcattttgcgatgcccatcccgatcgtactgtcgtcgtctacgccaacacttctgctgcggtaaaagcgcgcgcagattgggtggtaacttcaagcattgccgtcgaacttattgatcatcttgatagtttgggtgaaaaaatcatctgggcacccgacaaacatctggggcgttacgtgcaaaaacagacgggtggagacattctatgctggcagggtgcctgtattgtgcatgatgaatttaagactcaggcgttaacccgcttgcaagaagaatacccggatgctgccatactggtgcatccagaatcaccacaagctattgtcgatatggcggatgcggtcggttccaccagtcaactgatcgctgctgcgaaaacattgccacatcagaggcttattgtggcaaccgatcggggtattttctacaaaatgcagcaggcggtgccagataaagagttactggaagcaccaaccgcaggtgagggtgcaacctgccgcagctgcgcgcattgtccgtggatggccatgaatggccttcaggccatcgcaaaggcattagaacaggaaggaagcaatcacgaggttcatgttgaagaaaggctgcgagagagggcgctggtgccgctcaatcgtatgctggattttgcggctacactacgtggataacgaataataaggcgtaacgttacgctttgggggaaagatggatttttttagtgtgcagaatatcctggtacatataccaataggggcaggcggttatgatctctcatggatcgaagcggtaggcacgatcgccgggttgctgtgtattggccttgccagtctggagaagatcagcaactacttctttggcctgatcaacgtcaccttgtttggcattattttctttcagattcagctgtatgccagcctgctattacaggtgtttttctttgccgcgaatatttacggttggtatgcgtggtcgcgacaaaccagtcagaacgaggcggagttgaaaattcgctggttgccattgccgaaggcactcagctggttggcggtttgcgttgtttcgattggtctgatgacggtatttatcaatccggtgtttgcatttttgacccgcgtggcagtcatgatcatgcaagcattaggattacaggttgtgatgcctgaactgcaaccggacgctttcccgttctgggattcatgcatgatggtgttatctatcgtggcaatgattctgatgacgcgtaagtatgtggaaaactggctgttgtgggtgattattaacgtgattagcgtcgttatttttgcacttcagggcgtttacgccatgtctctggagtacatcatcctgacctttattgcgctcaacggcagccggatgtggatcaacagcgcacgtgaaagaggctcacgcgcgctgtcccattaatggtgatgatgtgaatggccagacaccccttcattcaggtggcagtctggcccatgacaaggttgatattccatctgaatggtggcgtgctcaatctgatagtgatccatcaggtagtgttggatctgatccaacaaggcatcgtgatcgtgtggcgggatcacctgcacatgcaacgtcatcaccggcttctcgcctaccatccatacatgtacatggtgcacattgcggacttccgggatttcccggcacatacgacgcttcagttcagcgatatccagcgataccggtgcaccttcaagtaattcattcacgctatctttcaacagtcgccacgcgctacgcagaaccagaagcgacaccagtatcgagagaatggggtcagcaggtgtccagccagtccagataataatcaacgcggcaataatagccccaaccgaacccagcaggtccccgagcacatgcagtgccgctgctcgtacgttgaggtttttctcttcgctgccgtgatgaagtaaccagaaagaaagtatatttgccagcaacccagccacggcaattgccatcatcatgccgccctcgaccggacgcggcgtgcggaagcgttctatcgcctcccagacaatcaaaatggtaattaccacgagggctatggcattcacaaacgccgcgagcgtggtcagtcttagccaaccgaaagtgtggcgaatggtgggaggacgacgtgaaaattgcacggcgagtagggcgaaaagcagggcggcagtatcggtcaacatatgacccgcatcggccagcaatgccagagaaccagaaagaaaaccaccaacgacttctaccagcataaacccggcagtcacgccgaaagcatacaacaagcgacgagcattattatcttctggcaggtgtgaggacgtgtgtgagtgtgagtgcgccatgacgagtcatcccttaattattctcacttaactttatgacatcatactgcttttagaagtgaaaaattaaaagggagagactccgctctcccattattggctattttgcagggttactgcgtggtaccgtcggttttggtatcgacatcattattgatgccgtcaccggtttgtacctttttattgatatccggacagcgaccatctttgcacatggtgttcttgtgctcttcatctttggtcattccgtcattgttcattgaagaaccatccgaatgcagcattgtgccgccagaaccggtatttaccccgttattgtcgacgttatttggcgcgacattttcacgggcgtcaggggctacctggcccgcatcagctgcggcgtttgcctggccgttattagtttgcgctccgctatcggcagccagtgcggcaccgctggcaaggcttagagtggcagtcagaaataatgtggccagttttgtcattttcataggatgctcctgttatggtcgttatgtcggataacctcttccaacagtgcatttgcaggtgaatataaggcattggtttaagatttcagccaggttatgaaacgcagcagagaatcttgaaataattaacaaacaaaggagttacagttagaaattgtaggagagatctcgtttttcgcgacaatctggcgtttttcttgctaattccaggattaatccgttcatagtgtaaaaccccgtttacacattctgacggaagatatagattggaagtattgcattcactaagataagtatggcaacactggaacagacatgaattatcagaacgacgatttacgcatcaaagaaatcaaagagttacttcctcctgtcgcattgctggaaaaattccccgctactgaaaatgccgcgaatacggttgcccatgcccgaaaagcgatccataagatcctgaaaggtaatgatgatcgcctgttggttgtgattggcccatgctcaattcatgatcctgtcgcggcaaaagagtatgccactcgcttgctggcgctgcgtgaagagctgaaagatgagctggaaatcgtaatgcgcgtctattttgaaaagccgcgtaccacggtgggctggaaagggctgattaacgatccgcatatggataatagcttccagatcaacgacggtctgcgtatagcccgtaaattgctgcttgatattaacgacagcggtctgccagcggcaggtgagtttctcgatatgatcaccccacaatatctcgctgacctgatgagctggggcgcaattggcgcacgtaccaccgaatcgcaggtgcaccgcgaactggcatcagggctttcttgtccggtcggcttcaaaaatggcaccgacggtacgattaaagtggctatcgatgccattaatgccgccggtgcgccgcactgcttcctgtccgtaacgaaatgggggcattcggcgattgtgaataccagcggtaacggcgattgccatatcattctgcgcggcggtaaagagcctaactacagcgcgaagcacgttgctgaagtgaaagaagggctgaacaaagcaggcctgccagcacaggtgatgatcgatttcagccatgctaactcgtccaaacaattcaaaaagcagatggatgtttgtgctgacgtttgccagcagattgccggtggcgaaaaggccattattggcgtgatggtggaaagccatctggtggaaggcaatcagagcctcgagagcggggagccgctggcctacggtaagagcatcaccgatgcctgcatcggctgggaagataccgatgctctgttacgtcaactggcgaatgcagtaaaagcgcgtcgcgggtaaggtttaattgtcggatgcgccgtcagagtggcgtatccgatgaatcaccacaggcctgataagtcgcgcagcgtcgcatcaggcaatgtgctccattgttagcaacaaaaaagccgactcacttgcagtcggctttctcattttaaacgaatgacgtttacttcgctttaccctggtttgcaaccgccgctgctttcgctgcgatctcgtcagcattacccagataatagcgtttcagcggtttgaaattctcgtcgaactcatacaccagcggcacgccagtcgggatattaagctcaagaatctcttcttcgctcatgttatcaagatatttcaccagcgcacgtaaagagttaccgtgtgcagcgatgatcacgcgctcaccgctcttcatacgcggcagaatagtttcattccagtaagggatcacgcggtcaatggtcagcgccaggctttccgtcagcggcagttctttctcgctcagtttcgcgtaacgcggatcgtgacccggataacgctcatcatctttagtcagttccggcggagtcactgcaaaaccacgacgccactgtttcacctgctcgtcgccatacttttcagcagtttccgctttgttcagaccctgcaacgcaccgtagtgacgttcgttcagtttccaggatttctcaacgggcagccatgcctgatccagttcgtccagcacattccacagggtatggatagcgcgtttcagcacagaagtgtaagcaaagtcaaagctgtaaccttcctctttcagcagcttacctgctgcttttgcttcgcttacgcctttctcagacagatccacgtcgtaccaaccggtgaaacggttttctttgttccactgactttcgccatgacgaaccagaaccagcttagttacagccatatacttactcctcaaatcatcttttaatgataataattctcattatattgccgcgacgaagcaacagcaatgcttacgcataaccatagcgaaaatagtggcgcagtgtaaggttgttgtgaatattgagttgcaaatatgtcggtgtttgctggtgatttgaacaatatgaagataaagccctcatgacgagggcttaacattactcagcaataaactgatattccgtcaggctggaatactcttcgccaggacgcaggaagcagtccggttgcggccattcagggtggttcgggctgtccggcagaaactcgctttccaacgccagcccttgccagtcggcgtaaggttcggttccccgcgacggtgtgccgccgaggaagttgccggagtagaattgaagagccggagcggtggtgtagaccttcagctgcaatttttcatctgctgaccagacatgcgccgccactttcttgccatcgcctttggcctgtaacaagaatgcgtgatcgtaacctttcactttgcgctgatcgtcgtcggcaagaaactcactggcgatgattttggcgctgcggaaatcaaaagacgttccggcgacagatttcaggccgtcgtgcggaatgccgccttcatcaaccggcagatattcgtccgccagaatctgcaacttgtgattgcgcacgtcagactgctcgccgtcaagattgaaatagacgtgattagtcatattcaccgggcaaggtttatcaactgtggcgcgataagtaatggagatacggttatcgtcggtcagacgatattgcaccgttgcgccgagattacccgggaagccctgatcgccatcatctgaactcagggcaaacagcacctgacgatcgttctggttcacaatctgccagcgacgtttgtcgaacccttccgggccgccgtgcagctggttaacgccctgacttggcgaaagggtcacggtttcaccgtcaaaggtataacggctattggcgatacggttggcataacgaccaatagaggcccccagaaacgcggcctgatcctgatagcattccgggctggcacagccgagcagcgcctcgcggacgctgccatcggaaagcggaatacgggctgaaagtaaagtcgcaccccagtccatcagcgtgactaccatccctgcgttgttacgcaaagttaacagtcggtacggctgaccatcgggtgccagtgcgggagtttcgttcagcactgtcctgctccttgtgatggtttacaaacgtaaaaagtctctttaatacctgtttttgcttcatattgttcagcgacagcttgctgtacggcaggcaccagctcttccgggatcaacgcgacgatacagccgccaaatccgccgccggtcatgcgtacgccacctttgtcgccaatcacagctttgacgatttctaccagagtgtcaatttgcggcacggtgatttcgaaatcatcgcgcatagaggcatgagactccgccatcaactcgctcatacgtttcaggtcgccctgctccagcgcgctggcagcttcaacggtgcgggcgttttcagtcaggatatgccgcacgcgtttcgccacgatcgggtccagttcatgcgcaacagcgttgaactcttcaatggtgacatcacgcagggctggctgctggaagaaacgcgcaccggtttcgcactgttcacgacgggtgttgtattcgctgccaaccagggtacgtttgaagttactgttgatgatgacgacagccacacctttgggcatggaaactgctttggtccccagtgagcggcaatcgatcagcaaggcatgatctttcttgccgagcgcggaaattagctgatccatgatcccgcagttacagcctacaaactggttttctgcttcctgaccgttaagcgcgatttgtgcgccgtccagcggcagatgataaagctgctgcaatacggttccgaccgcgacttccagtgaagcggaagaacttaacccggcaccctgcggcacattgccgctgatcaccatgtccacgccgccgaagctgttgttacgcagttgcagatgtttcaccacgccacgaacgtagttagcccattgatagttttcatgtgcgacaatgggcgcatcgagggaaaactcgtcgagctgattttcataatcggctgccatcacgcgaactttacggtcatcgcgtggtgcacaactgatcacggtttgataatcaatcgcgcagggcagaacgaaaccgtcgttgtagtcggtgtgttcaccaatcaaattcacgcggccaggcgcctgaatggtgtgagtggcagggtagccaaatgcgttggcaaacagagattgtgttttttctttcagactcatttcttacactccggattcgcgaaaatggatatcgctgactgcgcgcaaacgctctgctgcctgttctgcggtcaggtctcgctgggtctctgccagcatttcataaccaaccataaatttacgtacggtggcggagcgcagcagaggcggataaaagtgcgcgtgcagctgccagtgttgattctcttcgccattaaatggcgcgccgtgccagcccatagagtaggggaaggagcactggaagaggttgtcataacgactggtcagctttttcaacgccagcgccagatcgctgcgctgggcgtcggtcaaatcggtgatccgtaaaacgtgggctttgggcagcagtagcgtttcgaacggccaggcagcccagtaaggcacgacggctaaccagtgttcggtttcgacaacggtacggctaccgtctgccagctcgcgctgaacataatccaccagcattggtgatttctgttcggcaaaatattctttttgcagtcggtcttcgcgctcagcttcgttaggcaggaagctatttgcccaaatctgaccgtgcggatgcgggttagagcagcccatcgccgcgcctttgttttcaaaaacctgcacccatgggtacgttttccccagttctgcggtttgctcctgccaggttttgacgatttccgtcaatgctgcaacgctgagctctggcagcgttttactgtgatccggtgaaaagcagatcacccggctggtgccgcgcgcgctctggcaacgcatcagcggatcgtgactttctggcgcatctggcgtgtcagacatcaaagccgcaaagtcattagtgaaaacgtaagtcccggtgtaatcggggtttttatcgcctgtcacccgcacattacctgcgcagaggaagcaatctggatcgtgcgcaggtaacacctgtttggctggcgtttcctgcgccccctgccaggggcgcttagcgcggtgcggtgaaaccagaatccattgcccggtgagcgggttgtagcggcgatgtggatgatcaacgggattaaattgcgtcatggtcgttccttaatcgggatatccctgtggatggcgtgactgccagtgccaggtgtcctgcgccatttcatcgagtgtgcgcgttacgcgccagttcagttcacggtcggctttgctggcgtccgcccagtaggccggaaggtcgccctcgcgacgcggtgcaaaatgataattaaccggtttgccgcaggctttgctgaaggcattaaccacgtccagcacgctgttgcctacgccagcgccgaggttgtagatgtgtacgcctggcttgttcgccagtttttccatcgccacgacgtgaccgtccgccagatccattacgtggatgtaatcgcgtacgccagtaccatcttcggtcggataatcgttaccaaaaatcgccagcgagtcgcgacggcctacagcaacctgggcgatgtatggcatcaggttattcggaatgccttgcggatcttcgcccatatcgcccgacggatgcgcgccaaccgggttgaagtagcgcagcagggcaatgctccagtccggctgggctttttgcagatcggtgaggatctgttccaccatcagcttgcttttgccgtaagggctttgcggtgtgccggtcgggaagctttcaacgtatggaattttgggctgatcgccataaacggtggcggaggagctaaaaataaagtttttgacgttagcggcgcgcatggcgctaatcaggcgcagagtgccgttgacattgttgtcgtaatattccagcggtttttgtaccgattcgcccacggctttcagcccggcgaagtggatcacggtgtcgatagcgtgatcgtgcaggatctcggtcatcaacgcttcgttacgaatatcgccttcaacaaacgttggatgtttgccgcctaaacgctcgataacaggcagtacgctgcgcttactgttacagaggttatcaagaatgatgacatcatgaccgttttgcagtaattgcacacaggtatgacttccaatgtaaccgctaccaccggtaaccagaactctcataattcgctccattaggcttatggtatgaaataaccatagcataacaaagatgcgaaaagtgtgacatggaataaattagtggaatcgtttacacaagaatttagccgttttttatgcgcgattaagtgattataaaacagagggtttatgaatgattgcgctttttatctgaaaaaaagacgcggtttaatgcctgcatgcgtcgaaccgttggccggagagggcgcttaggccgcctccggcaaggtcagcactaccgactcaatatatttttgtcagcacatagcgatagagtccaccgtccggcacgaactcaaggcgatgggtaatacaggcaggcgcatcttcagcgtggtgcgaaacaaacaacaattgcgtttcaccttcgctaatcagcacatcaacaaaacggcggataagctggcgattgagcggatcaagcccctgtagtggttcatcgagaataagcaacgtcggatgtttcaccagtgcgcggacgatcagcgccagacgctgctgtccccaggaaagactatggaacggagcgtcagccgtgcgtttatcaatgccgagaatatccagccactgctgcaccagtttttgctggcgatccgaaacggcttgataaatgccaatcgaatcgaaatagccagaaagaatcacattacgcacggtagtgctgacccggtaatccagatgcaaactactgctgacgtaaccgatatgctttttgatatcccagatggtttcgccgctgccacgacgtcggccgaaaagcgtcaaatcgttgctgtaaccttgcggatgatcgccagtaatcaggcttaataacgtcgattttcccgcaccatttggcccgacaatttgccagtgttcgcctggattcacctgccagctaaggttattaagaatggggcgatcgttataagaaaccacgccattgttcagcacaatgcgcggttcgttggcgggtaaggcgtgacgtgctgaaggttcatccggttccggcagttgcacaccttcaagctgttcgctatgcgccagttgcgcgacgagtgcttgctggagcagttcctctttagcgcccgtttccgctaacgtacaatccgccagcacgccagcaaactggacaaattccgggatctcatcgaagcgattgagcaccagtaccagagtaataccggactgatgtaacgaggcgagtcgctcagccagctgctgacgtgaagcaacatccaggccatcgaacggctcatcaagaatcaacaagtcaggctccgacatcagcgcctgacacagcagggtttttcgcgtctcgccagtggaaaggtatttaaagcgtcggtcgaggagggcggtaataccgaactgctgcgccagttgcatgcaacgcggtgcatcctttacttcatcctgaataatctcagccgtagtgcgtccggtgtcatcttcgccagggccgagcatatcggtgttattccgttgccattcgtcgctgacgagcttttgcaattgctcgaaggagagacgagtgatgtgggaaaactggctttgccgttcacctttcaaaagcggaagttcccccgccagcgcgcgggccagggccgatttcccgcttccattcgaaccgacaaacgcccaactatcacccgcgtttaacgttagctgaggcaattgcagcgtttttgtgtcgctaagacgaaacgtgccttgcaaaatttgcaacgatgacattttatatcccattttgtgcagcgattactgacagggatacgtgtttcataacaaattgtcaacacgcttagcacagcgtggcgataatcacgctgtcggcattaaagtaggccgtgacattctgcccttgctgaagagaagtcgcttcatttaccggcactgtggcgcacagtgtttgcccgtcgggtagcgccattaatacttcgcactgctctgcgccgcgctcaatatgactaataatacccggtaattggttgtcggcgttttgcgcgaccgcctcgtcctgagtaatacctacccacggcgcttttagcaatatcaacacttctttgccttcatccagccccagacgcgcgccgctttgtgcggtaattgcgactttcaggcgtgtttttccgtcagccagtaagacatcaacatgctgttgaacgtcatcatgatcgcgggcggtgatggtaccgaaccactggttacgggcgctggtttgcagtgaaaaacgtgagatcgcggccagcaggctgttcagcggcagggcgtcatcgtcacttaacacatcaaaggctttttgctggatttgcgccagtaagtcatagagctgaatcagtcgctgaccatagcgggtcagtactgcgccgccgccacctttaccgcctgttgcgcgctcgaccagaatatgctcacttaactgattcatctcgttaatggcatcccaggcgcttttatagctaataccggcatctttcgctccctggctaatggaaccggaaagcgcaatgtgttttagtagcgaaatgcggcgcgggtcggcgaataatttttgttggagcttaagggtgagaaggatttcggcctgcataacaatgtcctggcaaaagtcttattgtgacggaaaacgaacgccacgcaaagctgaccgcacaaaaggggagtgcttttctgtgcttagcggttagaatagtctcatgactatatctggagttgaccatgttagagttattaaaaagtctggtattcgccgtaatcatggtacctgtcgtgatggccatcatcctgggtctgatttacggtcttggtgaagtattcaacatcttttctggtgttggtaaaaaagaccagcccggacaaaatcattgattccctgaatgcccgcttagtcgggcattttctttttctcaacttcctgcttttcctgccgatattttttcttatctacctcacaaaggttagcaataactgctgggaaaattccgagttagtcgttatattgtcgcctacataacgttacattaaggggttaccaatggctcgtaaatggttgaacttgtttgccggggcggcactctctttcgctgttgctggcaatgcactggcagatgaagggaaaatcacggtgttcgccgccgcatcactgactaacgcaatgcaggacattgctacgcagtttaaaaaagagaaaggcgtggatgtggtttcttctttcgcttcgtcatctactctcgcccgtcagattgaagcgggtgcgcctgcggatctgtttatttctgccgatcagaaatggatggattatgcggttgataaaaaagcgatcgatacagctacgcgtcagacactgctcggcaatagcctggtcgttgtagcaccgaaagccagcgtgcagaaagatttcaccatcgacagcaaaaccaactggacttcactgctgaatggcggtcgcctggcggttggcgatccggaacatgttcccgctggcatttatgcaaaagaagcactgcaaaaactgggcgcatgggatacgctctctccgaaactggccccagcggaagatgttcgtggggcgctggcgctggtcgaacgtaacgaagcgcctctgggcattgtctacggttctgacgcagttgccagcaaaggggtaaaagtggttgccaccttcccggaagattcacataaaaaagtggaatatccggttgctgttgtggaagggcataacaatgcgacagtgaaagcattttatgattatctgaagggaccgcaggcagcggaaatctttaaacgttacggatttacaatcaagtaatgatactgaccgatccagaatggcaggcagttttattaagcctgaaagtttcttccctggctgtgctgtttagcctgccgtttgggatcttttttgcctggttactggtgcgttgcacgtttccgggcaaagctctgctcgacagcgtactgcatctaccgctggtgttaccgcccgtggtcgtcggttacttattattagtttcgatgggacggcgcggatttatcggtgaacgtctgtatgactggtttggtattaccttcgcctttagctggcgcggcgcggttctcgctgccgccgtcatgtcgtttccgctgatggtgcgggcaattcgtctggcgctggaaggggttgatgtcaaactggaacaggccgcaagaacactgggggccgggcgctggcgcgttttctttactatcacgttaccgctgaccttaccgggaattattgttggtacggtactggcttttgctcgttctctcggtgagtttggtgcaaccatcacctttgtgtcgaacattcctggtgaaacgcgaaccattccttctgccatgtataccctgatccagacccccggcggggaaagtggagcggcgagactgtgcattatttctattgcgctggcgatgatctccctgttgatttcagaatggctggccagaatcagccgtgaacgggcggggcgctaatcatgctggaactgaatttttcccagacgttgggcaaccattgcctgactattaatgaaacgctgcccgccaatggcatcactgctatctttggcgtctccggtgccggaaaaacttcgctgattaacgccatcagtggactgacgcgcccgcaaaaagggcggattgtcctcaatgggcgggtactaaatgatgccgaaaaaggtatctgcctgacgccggaaaagcgtcgcgttggctatgtttttcaggatgcgcggctgttcccgcattacaaagtgcgtggcaatctgcgctacggcatgtcgaaaagtatggtcgatcagttcgataagctggtggcgcttttaggcattgaaccgttgcttgaccgtttaccaggcagcctgtccggaggcgaaaaacagcgcgtggcgattggtcgggctttgctgacagcaccggaattgctgttgctggatgaaccgctggcgtcactggatattccgcgtaaacgcgaactgttgccttatctgcaacggctgacacgggaaatcaacattccgatgttgtatgtcagccattcgctggatgagatcctccatctggcagacagagtgatggtactggaaaacggtcaggtgaaagcctttggcgcgctggaggaagtgtggggcagtagcgtgatgaatccgtggctgccgaaagagcaacaaagtagcattctgaaagtgacggtgcttgagcatcatccgcattacgcgatgaccgcgctggcgctgggcgatcagcatttgtgggtcaataagctggacgaaccgctgcaagctgcgctacgtatccgcattcaggcttccgatgtttctctggttttacaaccgccgcagcaaaccagcattcgtaacgtattgcgggcaaaagttgttaatagttatgacgacaacggccaggtggaagtggaactggaagtcggcggtaaaacgctgtgggcgcgtatcagcccgtgggccagggatgaactggcgatcaaacctggcctgtggctgtacgcgcaaattaaaagtgtgtcgataaccgcctgattaaatcaggtggctataaatgaattgggcaatgctgtcggtggtgttatcaccaatcacaatgttggcgcgcgcttttaccgcgtcatcggcgttgcccatcgccacgcctgtaccagcggcttccagcatactgatatcattaaagttatcgccgaatgccacgacgttttccatcgaccaaccttgcgcctcaacccatttcgtcaaacgtttacctttgctgttgccgccgcgtgcaatatcaacctgatcgtgccaggaccattcacactccagtcctagttcatgttcgacatgcttaccaaaatgctgcaattgcggcaggtcatcgtgcgtcagggcgaacttccatacggcgttaacttgttgcgccgtttcagccagagaagcgacttgtgtgaaagtcggacgctgttccggcggcagggtttgcgcccagttagatgtgcgaatgacatgcccggtcgggtgctcatagaccattgcatcatcgacatacatcagaccgtgaatgtggtgttcattcagcatctcaatgagttgcagggctttaataacgggcattgggtccgcttccagcacggtttttgcatgataatcatacaaataggtgccattacagcaaatagcaggtgtatccagcgccagcgcctgataaaaaggatgaatagcgacgtgatggcgacctgtgacgatgattaattgatagcctgcttcgcgagcgcgggccagggcttctatcgatgaaggaagcagggtctttttcggggtcaataaggtgccgtctaagtcgagagcaatcacgcgtgtggtcatggcgtattccagattaaggttaagaattttcgtctgcgcgaatggtacaccgataccactatcggacaaaattctgcgttttaattcagcattcaccgccaaaagcgactaattttagctgttacagtcagttgctaaatgcaaaggagcattcatgaagcaaacagtttatatcgccagccctgagagccagcaaattcacgtctggaacctgaatcatgaaggcgcactgacgctgacacaggttgtcgatgtgccggggcaggtgcagccgatggtggtcagcccggacaaacgttatctctatgttggtgttcgccctgagtttcgcgtcctggcgtatcgtatcgccccggacgatggcgcactgacctttgccgcagagtctgcgctgccgggtagtccgacgcatatttccaccgatcaccaggggcagtttgtctttgtaggttcttacaatgcgggtaacgtgagcgtaacgcgtctggaagatggcctgccagtgggcgtcgtcgatgtggtcgaggggctggacggttgccattccgccaatatctcaccggacaaccgtacgctgtgggttccggcattaaagcaggatcgcatttgcctgtttacggtcagcgatgatggtcatctcgtggcgcaggaccctgcggaagtgaccaccgttgaaggggccggcccgcgtcatatggtattccatccaaacgaacaatatgcgtattgcgtcaatgagttaaacagctcagtggatgtctgggaactgaaagatccgcacggtaatatcgaatgtgtccagacgctggatatgatgccggaaaacttctccgatacccgttgggcggctgatattcatatcaccccggatgggcgtcacttatatgcctgtgaccgtactgccagcctgattactgtcttcagcgtttcggaagatggcagcgtgttgagtaaagaaggcttccagccaacggaaacccagccgcgcggcttcaatgttgatcacagcggcaagtatctgattgccgctgggcaaaaatctcaccacatctcggtatacgaaattgttggcgagcaggggctactgcatgaaaaaggccgctatgcggtcgggcagggaccaatgtgggtggtggttaacgcacactaaccgctgatttacccggcgcagtctctcctgcgccggtgtattaacctatctcctgtaacgcgtgtctctggcgttcgacgatattggtccacaaattgtctttatcgtcagtccataaattaatcagcaaggcaaaaaagcgttctgctgctggagaaagtacggcatctttacggcgaattattcccaatgttcgacgtataacgggttccaccaatgggataccaataatcgaagaatagggcgcatgaggcattgccaggccaggaagcgccgaaatccccagtcccgcctccaccagtcctaatgacgtcgaaagatgacgcacttcgtaaaaccagtccagcttccagggcttgtcggccagctgttgttctatcaacagtcggttgccgctggaggagcgtacgccaatcattttgtaacccactaactcctgccattctacaagctgctttttggccaatggatggtcacgccgacaggccagcacgaacggctcgttgaccagtggggtaaaatcaatggatgaatttgtgacgttgttcatgtttatgccaaagtctgattcgttacacagcaccgattccatgcaattattcgtgccttgttccagaatccgcactttaatattgggatacagctcattaaatttaccgattgccagcggtaaaaaataaaatactgcggtcggaatacacgctaacgtcaccataccacgatgataagcattcatatcacgaatattaaaaagcgtttcatcgaatttctttattaattcccgcgcctccgggagcaacctttttcctgcttttgttaacgtaaccttgcgagttgtacgctcaaatagttgaatatgtaaatcttcctccatcttttttattcttcgcgttaatgcaggttgcgtaatattgagtaatttagcggcattgttaaacgaactggactctgccagtatgacaaatgccttcatacttgataattcatgcttcattattactccgggaaatggaagcgacgattttgggtggctggccgttaaaaattttaactgcatttagccaacttaaattaatgaaaaaatgttattaatcgttgagctaaagtcattagagatgctttgcccttaatgtaaccatatcgcaataagttatgtttttaaattgagggcattattatgaaaaaaataccctgcgtgatgatgcgaggtggaacctcgaggggcgcgttcctgttagcggaacatttacccgaagatcaaacgcagcgcgataaaatattgatggcaattatgggttccggtaacgatctggaaattgacggtattggcggcggtaatccactgaccagtaaagtcgccattattagccgttccagcgatccgcgtgctgatgtcgattatctgtttgcgcaggtaatcgttcatgagcaacgtgtcgataccacgcctaactgcggcaatatgctgtctggtgttggggcattcgccattgaaaatggtttgattgcagcgacttcgccagttactcgcgtacgtatccgcaacgtcaatacgggtacgttcatcgaagctgatgtgcaaacgccaaatggtgttgtcgagtacgagggtagcgccagaattgacggcgtaccgggtactgccgcaccggttgcgctcactttcctgaatgccgctggaaccaaaaccggaaaagttttcccgactgataatcagattgattattttgacgatgccccggtgacctgtatcgatatggcgatgccagtcgtcattattccggctgaatatctgggaaaaacaggttatgaattaccggcggaactggatgccgacaaagcattattagcccgcattgaatctatccgtctacaagcgggtaaagcaatgggcttaggtgatgtcagtaatatggttatccctaaacctgtgcttatttctccagcgcagaaaggcggggcaattaatgtgcgttattttatgccgcattcttgccatcgcgcgctggcgataaccggtgctattgctatttccagtagttgtgcattggaaggcaccgtcacccgacaaatcgtcccttctgtaggatacggcaatatcaatattgaacaccccagtggtgcgctcgacgttcatttaagtaatgaaggtcaggatgccacgacgttacgcgcatctgttattcggacgaccagaaaaatattttccggtgaagtttatcttccctgaaaaaattcgttgtcaggataaggacaatcaataaaggacttctgtatgagtcatacagaaagaacaggattttaaatgaataagaaatcgttatggaagctaattctgatattagcgatcccatgtattattggctttatgccagctccggcaggattaagcgaactggcgtgggtgctttttggtatttacctggcggccattgtggggctggttatcaagcctttcccggaacctgtcgtactgttaattgccgttgctgcctcaatggtggtggtcggtaacttatccgacggtgcgtttaaaaccaccgccgtattaagcggttactcttcaggtaccacctggctggtgttctcggcgtttaccttaagcgccgcatttgtgaccaccggtttaggtaaacgtattgcctatctgctgattggtaaaatcggtaacaccacgctgggtctgggttacgttacggtattcctcgatctggtactggctccggcaacaccgtctaacaccgcgcgtgcgggcggcattgtgttaccgatcatcaacagcgtggcggtggctttggggtccgaaccggaaaaaagtccgcgtcgtgtcggacattacctgatgatgtccatttacatggtcaccaaaaccaccagctatatgttctttaccgcaatggcggggaacattctggcgctgaaaatgatcaacgacattctgcacctgcaaattagctggggtggatgggcgctggcagccggattgccgggcatcattatgctgctggtcaccccgctggtgatttacaccatgtatccaccagaaattaagaaggtggataacaaaaccatcgctaaagcgggccttgccgaactaggaccgatgaaaatccgcgaaaaaatgctgctcggtgtctttgtgctggcgctgctgggctggattttcagtaagtctctgggggttgatgaatccaccgtggcaatcgttgttatggcaaccatgctgctgctgggtatcgttacctgggaagacgtggttaaaaataaaggcggctggaataccttaatctggtacggcggtattatcggcttaagctccttattatcgaaagttaaattcttcgaatggttagctgaagtctttaaaaataacctggcatttgatggtcacggtaacgttgctttcttcgttattattttcctcagcattatcgtgcgttatttcttcgcttccggtagtgcctatatcgttgctatgttaccggtatttgccatgctggcgaacgtctccggcgcaccgttaatgttaaccgcgctggcactgttgttctccaactcctatggcggcatggttactcactatggcggcgcggcaggtccggtcatctttggcgtgggttataacgatattaaatcctggtggttggtcggtgcggtactgacgatattaaccttcctggtgcatatcaccctcggcgtgtggtggtggaatatgctgatcggctggaacatgctgtaaatatactcgtcatacttcaagttgcatgtgctgcgtttgcgttcgctcaccccagtcacttacttatgtaagctcctggggattcactcacttgtcgccttcctgcaactcgaattatttagagtatatccatttattatctttctgcgcacttcacggtgcgcagatatctggagcatctgatgatcaagttatctgaaaaaggcgtgtttctcgccagtaataacgaaataattgccgaagaacatttcaccggcgaaattaaaaaagaagaagccaaaaaaggcactattgcctggtctattctctcttctcataatacgtccggaaatatggataaacttaaaattaagtttgattcattagcctctcacgatattacctttgttggtattgtacagaccgctaaagcgtccggaatggaacgtttcccgctgccgtatgtgctgaccaactgccataactcactctgcgccgtcggcggcaccattaacggtgatgaccatgtttttggtttatcggcagctcagcgttatggcggtatttttgtgcctccgcatattgcggtcatccatcaatatatgcgtgagatgatggcaggcggcggcaaaatgatcctcgggtcagacagccacacccgttacggtgcattagggacaatggcagtcggtgagggcggcggtgagttggtaaaacagctgcttaatgacacctgggatatcgactatccgggagttgttgcggtgcatctgaccggaaaaccagcgccgtatgtggggccgcaggatgtggcgctggctatcatcggtgccgtgttcaaaaacggctacgtcaaaaacaaagtgatggaattcgtaggtcccggtgttgctgcgctctctaccgatttccgtaacagcgttgacgttatgaccactgaaacgacctgtttaagttctgtctggcaaaccgatgaagaagtccataactggctggcgctgcacggtcgcggccaggattactgccagcttaaccctcaaccgatggcgtactacgatggctgcatcagcgttgatttaagcgccatcaaaccaatgattgcgctgccgttccacccgagcaacgtgtatgaaatcgacacactgaaccagaacctgaccgacattctgcgtgagattgaaattgagtccgaacgcgtggcgcacggtaaagccaaactctcgctgctggataaagtggaaaatggtcgcctgaaagtgcagcaggggattatcgcgggctgttctggcggtaactacgaaaacgtcatcgcggcggcgaatgcactgcgcggtcaatcctgtggcaatgacaccttctcgctggcagtttacccgtcatcacagccggtgtttatggatctcgccaaaaaaggtgtggtagcagatttgattggcgcaggcgcaatcatcagaaccgcgttctgcggcccatgctttggcgcgggcgatacgccaatcaacaacggattaagtattcgccacaccacgcgcaacttcccaaaccgcgaaggctctaagccagctaatgggcagatgtcagcggtggcgttgatggacgctcgttctatcgctgcgactgcggcaaacggtggctatttaacctctgccagcgaacttgattgctgggacaacgtgccggagtacgccttcgatgtaacgccgtataaaaaccgtgtttatcagggctttgtgaaaggggcaactcagcaaccgctgatttacggaccgaacattaaagactggccggaattgggtgcgctgactgacaatatcgtcctgaaagtgtgctcgaagatcctcgacgaagtgaccaccaccgacgaactgattccttccggtgaaacctcttcttatcgttcaaatccgattggtctggcggagtttaccctgtcacgccgcgatcccggttatgttggcagaagtaaagcgactgctgagctggaaaatcagcgtctggcggggaatgtcagcgagctgacagaggtgtttgcgcgcattaagcagattgctggtcaggagcatattgatccgctgcaaactgaaattggcagcatggtatatgcggtgaaaccaggcgatggttctgcgcgtgaacaggcggcgagctgccagcgtgtgattggcggtctggcgaatattgccgaagagtacgcgactaaacgctaccgttctaacgtcatcaactgggggatgttaccgctgcagatggcggaagtgccaacctttgaagtgggggattacatttacatccctggcattaaagcggcgctggataatccgggtacgacgtttaaaggttatgtgatccatgaagatgcgccggtaacggaaattacgctctatatggaaagtctgactgctgaagagcgcgagattatcaaggcgggtagtttgattaacttcaataaaaaccgtcagatgtaaaaagcgccatgtgaatgtaggtcgcattcggcacttattgtcggatgcgatgcttgcgcatcttatccgacctacgaatcgcatcgaatctgtaggccagataaggcattttcgcagcatccggcacttattgtcggatgcgatgcttgcgcatcttatccgacctacaaatcgcatcgaaccgtaggccggataaggcgtttacgccgcatccggcaaatagttaattgctcttacttcttcgcctctgcaaccactttactacccacgccgcggttattgtattcccacatgcggttgtagttagtgtcattcagattgcgctgtatttcgtcgttatcatctacgctgccggtattacccgcaaacggacgattagagatcaccgcatcggcccacggtttagccgtgttaaaaccttcgttgatggcgctatcacggatcaccacctgaccgttggtattggcatcaacatccagcgagcggcccagttgcgccacaccatcaccgaaagcattgaaacggctgtttacggcgaggaaaccgtagtaaatgttggacagcgtagccggtgcaaacacatacgcttcttgctgagtacgtgagttcaccacgcggaattcggtgttatcgaacaccactgcgccgcgaccagaaacgatatccacatccccttcaatgtagctgttggtcaccagcgtacgcggctgacgattcgtttccagacggttctgcacaccgctgttggtgacaaagaaggtgttctgacgaccgagaatgttaacgttgttaatctgtacctggtcaccatcagtacgcagtgccaccgccggatggttacctgcatctacgctatcgcccagcgtgttttcgatggtcagattttgcagttgcaggccattgttttgtgaccagaagaccgctgagcagagaacaccgatactgtcgctgcgtttgctctggcagctatcgtacatataccacgctggtttacctggcatatatttgccgcgcgggttgacgtcgtgacgccagtcggcagggctcatgccaccatcaagggaaagcccaatcttcacatcaatcggtttttcacctgtaccgtacagagtaattccacccggagcggcagggacatataccgttccctgatactcaccaggcatcacggcaatatactggcgcttgttggtacgcttgataattgccgcatctaccgccgcctgaatcgtggtatgcgttacaccttgagtgcccgccgggccgacaacaaagtcaggttgcgcaggcagggtaatcggggaaggattccacgctgcagcacctggtgtcagggatgcaaaatagtgttgagcatcgaaattctgcgcttcttttgccgacagaatcgggcgagaagaggtaccaggcgcggtttgatcagaaggacgttgatcgggcggggttgagctacaggcggtcagcgtcacgccaaaagccaatgccagcgccagacgggaaactgaaaatgtgttcacaggttgctccggtctatgaaatagaaaaatgaatccgttgaagcctgcttttttatactaacttgagcgaaacgggaaggtaaaaagacaaaaagttgtttttaatacctttaagtgataccagatggcattgcgccatctggcagagtgattaactaaacatcgcagtaatcgaggcgcttgccagagagtggaaatgaacgttaaacccgaccatcgcgccgctggcaccttcatcgacatcaatacgttctatatccagcgcgtgaacggtaaaaatgtagcgatgagtttcgcctttcggcggtgctgcgccatcgtacccggttttaccaaagtcggtacgcgtctgcaaaacgccgtctggcattgctaccagaccagagccaaacccttgcggtaatacgcgggtatcagcgggtaagttaacaactacccagtgccaccagccggagccggttggcgcatccgggtcgtagcaggtgacaacaaaacttttcgttcccgcaggaacatcatcccacgccagatgcggtgaaatattatcgccatcgtaacccatgccgttaaagacatgacgatgcggcaatttatcgccatcgcgcagatcgttactgatgagtttcatgaaccctcctttcttgtttgcagaaagtgtagccagaaaccctcacgcggacttctcgttattggcaaaaaaatgtttcatcctgtaccgcgcggttaaccgctgcggtcagacgctgcaactgttgcgggagaataatatagggcggcatcaggtaaatcagtttgccaaaaggtcggatccagacaccctgttcgacaaagaatttttgcagcgccgccatattcaccggatgagtggtttcgaccacgccaatggcccccagtacgcgcacatcggcaaccatttcggcatcacgggcgggggcaagttgctcgcgcagctgtacttcaatatccgccacctgttgctgccagtcgccagattcgagaatcgccaggctggcgtttgctgccgcgcaggccagcggattgcccataaaagttggcccatgcataaagcaaccggcttcaccgttactgatggtttctgcaacctcgcgcgtggtgagtgtggcggaaagggtcattgtgccgccggttaaggctttaccgaggcacaaaatgtccggcgcgatttctgcatgttcacaggcaaacagtttcccggtacgaccaaatccagtggcgatctcgtcggcaatcagcaagataccttcgcgatcgcatattttgcggattcgttttaaccattccggatggtacatgcgcatcccgcctgcgccctggacaatcggctcaatgatcaccgccgcgatttcatgacgatgcgccgccatcaggcgggcaaagcccaccatatcgcgctcatcccattcgccatccatacggctttgtggggcgggagcaaacaagttttctggcagatagcctttccacaggctgtgcattgagttgtccggatcgcacaccgacatcgcgccaaaggtatcgccatgataaccattgcggaaggtcagaaaacgctggcgcgcttcgcctttggcctgccagtactgcaacgccattttcatcgccacttccaccgctacggagccggagtccgcgagaaaaacgcattccagcggttgcggcgtcattgccaccagtttgcggcatagctcgatggcgggcgcatgggtgataccgccaaacatcacatgcgacatagcatcaatttgcgacttcatcgccgcattaagctgcgggtgattatagccgtggatcgccgcccaccaggacgacataccgtcaaccaggcgtctgccgtcagacaaaattagctcgcaaccttcggcgctcgcgaccggataaaccggcagaggggaggtcatggatgtgtatgggtgccagatatggcgttggtcaaaggcaagatcgtccgttgtcataatcgacttgtaaaccaaattgaaaagatttaggtttacaagtctacaccgaattaacaacaaaaaacacgttttggagaagccccatggctcaccgcccacgctggacattgtcgcaagtcacagaattatttgaaaaaccgttgctggatctgctgtttgaagcgcagcaggtacatcgacagcatttcgatcctcgtcaggtgcaggtcagcactttgctgtcgattaagaccggagcttgtccggaagattgcaaatactgcccgcaaagctcgcgctacaaaaccgggctggaagccgagcggttgatggaagttgaacaggtgctggagtcggcgcgcaaagcgaaagcggcaggatcgacgcgcttctgtatgggcgcggcgtggaagaatccccacgaacgcgatatgccgtacctggaacaaatggtgcagggggtaaaagcgatggggctggaggcgtgtatgacgctgggcacgttgagtgaatctcaggcgcagcgcctcgcgaacgccgggctggattactacaaccacaacctggacacctcgccggagttttacggcaatatcatcaccacacgcacttatcaggaacgcctcgatacgctggaaaaagtgcgcgatgccgggatcaaagtctgttctggcggcattgtgggcttaggcgaaacggtaaaagatcgcgccggattattgctgcaactggcaaacctgccgacgccgccggaaagcgtgccaatcaacatgctggtgaaggtgaaaggcacgccgcttgccgataacgatgatgtcgatgcctttgattttattcgcaccattgcggtcgcgcggatcatgatgccaacctcttacgtgcgcctttctgccggacgcgagcagatgaacgaacagactcaggcgatgtgctttatggcaggcgcaaactcgattttctacggttgcaaactgctgaccacgccgaatccggaagaagataaagacctgcaactgttccgcaaactggggctaaatccgcagcaaactgccgtgctggcgggcgataacgaacaacagcagcgtctggaacaggcactgatgaccccggacactgacgaatattacaacgcggcagcactatgagctggcaggataaaatcaacgcggccctcgatgcgcggcgtgctgccgatgccctgcgtcgccgttatccagtggcgcaaggagcaggacgctggctggtggcggacgatcgccagtatctgaacttttccagtaacgattatttaggtttaagccatcatccgcaaattatccgtgcctggaagcagagtgcagagcaatttggcgtcggtagcggcggctccggtcacgtcagcggttatagcgtggcacatcaggcgctggaagaagaactggccgagtggctgggctattcgcgggcactgctgtttatctctggttttgccgctaatcaggcggtcattgccgcgatgatggcgaaagaggaccgtattgttgccgaccggcttagccatgcctcattgctggaggctgccagtttaagcccgtcgcagcttcgccgttttgttcataacgatgtcactcatctggcgcgactgcttgcttccccctgtccggggcagcaaatggtggtgacagaaggcgtgttcagcatggacggcgatagtgcgccactggcggaaatccagcaggtaacgcaacagcacaatggctggttgatggtcgatgatgcccacggcacgggcgttatcggggagcaggggcgcggcagctgctggctgcaaaaggtaaaaccagaattgctggtagtgacttttggcaaaggatttggcgtcagcggggcagcggtgctttgctccagtacggtggcggattatctgctgcaattcgcccgccaccttatctacagcaccagtatgccgcccgctcaggcgcaggcattacgtgcgtcgctggcggtcattcgcagtgatgagggtgatgcacggcgcgaaaaactggcggcactcattacgcgttttcgtgccggagtacaggatttgccgtttacgcttgctgattcatgcagcgccatccagccattgattgtcggtgataacagccgtgcgttacaactggcagaaaaactgcgccagcaaggctgctgggtcacggcgattcgcccgccaaccgtacccgctggtactgcgcgactgcgcttaacgctaaccgctgcgcatgaaatgcaggatatcgaccgtctgctggaggtgctgcatggcaacggttaataaacaagccattgcagcggcatttggtcgggcagccgcacactatgagcaacatgcagatctacagcgccagagtgctgacgccttactggcaatgcttccacagcgtaaatacacccacgtactggacgcgggttgtggacctggctggatgagccgccactggcgggaacgtcacgcgcaggtgacggccttagatctctcgccgccaatgcttgttcaggcacgccagaaggatgccgcagaccattatctggcgggagatatcgaatccctgccgttagcgactgcgacgttcgatcttgcatggagcaatctcgcagtgcagtggtgcggtaatttatccacggcactccgcgagctgtatcgggtggtgcgccccaaaggcgtggtcgcgtttaccacgctggtgcagggatcgttacccgaactgcatcaggcgtggcaggcggtggacgagcgtccgcatgctaatcgctttttaccgccagatgaaatcgaacagtcgctgaacggcgtgcattatcaacatcatattcagcccatcacgctgtggtttgatgatgcgctcagtgccatgcgttcgctgaaaggcatcggtgccacgcatcttcatgaagggcgcgacccgcgaatattaacgcgttcgcagttgcagcgattgcaactggcctggccgcaacagcaggggcgatatcctctgacgtatcatctttttttgggagtgattgctcgtgagtaaacgttattttgtcaccggaacggataccgaagtggggaaaactgtcgccagttgtgcacttttacaagccgcaaaggcagcaggctaccggacggcaggttataaaccggtcgcctctggcagcgaaaagaccccggaaggtttacgcaatagcgacgcgctggcgttacagcgcaacagcagcctgcagctggattacgcaacagtaaatccttacaccttcgcagaacccacttcgccgcacatcatcagcgcgcaagagggcagaccgatagaatcattggtaatgagcgccggattacgcgcgcttgaacaacaggctgactgggtgttagtggaaggtgctggcggctggtttacgccgctttctgacactttcacttttgcagattgggtaacacaggaacaactgccggtgatactggtagttggtgtgaaactcggctgtattaatcacgcgatgttgactgcgcaggcaatacaacacgccggactgactctggcgggttgggtggcgaacgatgttacgcctccgggaaaacgtcacgctgaatatatgaccacgctcacccgcatgattcccgcgccgctgctgggagagatcccctggcttgcagaaaatccagaaaatgcggcaaccggaaagtacataaaccttgccttgttgtagccattctgtatttggttaaattgcgagcgagatcgcgtcttcgattgactgcaatttaaccaattaaattctaaaataatcacgaaaaaaattttacttccgcctcatgcggcgaatgtgggaattgcccaggcggcgggggataggggctggagacagttatccactattcctgtggataaccatgtgtattagagttagaaaacacgaggcaagcgagagaatacgcggcttgcacgcgaattggcgttaaagacggctcaaagaaatatcttttattttttaactggttagataaatgcaatggcagtcactgaacaggcatctcttgccataaaactgtcatcactcatcttgacaaatgttaaaaaagccgttgctttggggataacccggtaaggccggagttttatctcgccacagagtaaattttgctcatgattgacagcggagtttacgctgtatcagaaatattatggtgatgaactgtttttttatccagtataatttgttggcataattaagtacgacgagtaaaattacatacctgcccgcccaactccttcaggtagcgactcatgagtaaaccgttcaaactgaattccgcttttaaaccttctggcgatcagccagaggcgattcgacgtctcgaagaggggctggaagatggcctggcgcaccagacgttacttggcgtgactggctcagggaaaaccttcaccattgccaatgtcattgctgaccttcagcgcccaaccatggtacttgcgcccaacaaaacgctggcggcccagctgtatggcgaaatgaaagagttcttcccggaaaacgcggtggagtatttcgtctcctactacgactactatcagccggaagcctatgtaccgagttccgacactttcattgagaaagatgcctcggttaacgaacatattgagcagatgcgtttatccgccaccaaagcgatgctggagcggcgtgatgtggttgtggtggcgtctgtttccgcgatttatggtctgggcgatcctgatttatatctcaagatgatgctccatctcacggtcggtatgattatcgatcagcgcgcgattctgcgccgactggcggagctgcaatacgctcgtaatgatcaagcattccagcgtggtactttccgcgttcgtggcgaggtgatagatatcttcccggcagaatcggatgacattgcacttcgcgtggaactgtttgacgaggaagtggaacgattgtcgttatttgacccgctgaccgggcagattgtttccactattccacgttttaccatctacccgaaaacgcactacgtcacaccgcgcgagcgcatcgtacaggcgatggaggagatcaaagaagagctggccgccagacgcaaagtgctgttggaaaacaacaaactgctggaagagcagcggctgacccagcgtacccagtttgatctggagatgatgaacgagctgggctactgttcggggattgaaaactactcgcgcttcctctccggtcgtggaccgggtgagccaccgccgacgctgtttgattacctccctgctgatgggctgctggtggtcgatgaatctcacgtcaccattccacaaattggcggcatgtatcgcggtgaccgggcgcgtaaagagacactggtggagtacggcttccgcctgccatcagcgctggataaccgtccgcttaagtttgaagagttcgaagcattagcgccgcaaaccatctatgtttcggcgacgccgggtaattacgagctggaaaaatccggcggcgatgtggtggatcaggtggtgcgtccaaccggattgcttgacccgattatcgaagtgcggccggtggcgacacaggttgatgatcttctttcggagattcgtcagcgagcggcaattaacgaacgcgtactggtcaccacactgaccaagcggatggcggaagatcttaccgaatatctcgaagaacatggcgagcgcgtgcgttatcttcactcagatatcgacaccgtcgaacgtatggagattatccgcgacttgcgtctgggtgagttcgacgtgctggtagggatcaacttactgcgcgaaggtctggatatgccggaagtgtcgctggtggcgatcctcgacgctgacaaagaaggcttcctgcgttccgaacgttcgttgatccagaccattggtcgtgcggcacgtaacgttaacggtaaagcgattctctacggcgataagatcaccccatcaatggcgaaagcgattggcgaaaccgaacgtcgccgcgagaaacagcagaagtacaacgaagaacacggcattacgccgcaaggcttgaacaagaaagtggtcgatatcctggcgctggggcagaacattgccaaaaccaaagcgaagggcagaggaaaatcgcgcccgattgttgagccggataatgtgccgatggatatgtcgcctaaagcgctgcagcagaaaatccatgaactggaagggttgatgatgcaacacgcgcagaatctggagttcgaagaagcggcgcaaattcgtgaccagttgcatcagctgcgtgaattgtttatcgcggcgtcgtgacaggataacgatgaagacagatgacaaaagcaaaattgcctgatgtgctacgcttatcaggcctacatgatctctgcaatacattgaattagcgcggtttgtaggccggataaggcgttcacgccgcatccggcataaacaacgcgcactttgtcttcaataggaagccggaattttccttcggatttccgttaacctaaagcctgtaacgccttttccagcgcgttatgtaacaactggcggtcatgacgatacggaatatcgctggcctccagtacctcctggatcacaatccgctctttcaccgccgagacatccacttttggcccgacgatgaccgcatcaatgacctttttaccaacatactgctccataattgccagcttgctttccagcttcaaattagccgcaggtaaactcaactcacgccccagattgccgatataaaccatcggcgctggcgtgcggcgtaatgcctgggcgatttccttcagcagcagaattggcatcaggctggtataaaaactgccaggcccaataatgatgagatccgcttcattgatagcgtgaaccgcctcacgcgttgcgggtacattaggcgttaacaataactcttgaatcggcgtagttaactggtcgatattgacctcgccgtaaacttcatgcccctgatcgtcaatcgccatcagatcaacaggatgctctgacattggaatcaaatgcgtatccactttcagcagattacgaattaaattgatggcttccagaggccgcacgctaaggtgatccagcgcctttaacatcaagtttccgagattatgaccggaaagttcgccattgccaccaaaacggtattcaaacatcgcggaggcgacgctcggttccgttatcagctgattgaggcagttgcgcatatcgccccaggcaatgccgccttctgaacggcgaatacgccccgtcgagccaccattatcggtggtggtgacgatacccgttaaacgagaacccaaagacgaaagtgatgagagaacgcgtcccagtccatgccctccgccgagagcaacgacacgatcaagatcagccagcgtacgattgcgcatatagtttcctggagtcagattatccgcgctacagtagcgcaaattgcggggaaacagcaattaacctgccaatattgaggatacaaactattttcttctacctctaaaggacgatgcacgctatgccgccctgatgatgtatatcaaagtaaaactgccattttcccttattctgtagcgaaatagcacgatcatgacgctatatacatgattacatagcgaaagtgtggatggtaaaaatctcatttacacgctagtatcggcttaaccactaaacactctagcctctgcacctgggtcaactgatacggtgctttggccgtgacaatgctcgtaaagattgccaccagggcgaaggaagaaatgacttcgcctcccgtatctggaaaggtgtacatggcttcacaactgactgatgcatttgcgcgtaagttttactacttgcgcctgtcgattaccgatgtgtgtaactttcgttgcacctactgcctgccggatggctacaaaccgagcggcgtcaccaataaaggctttcttaccgtcgatgaaattcgccgggttacgcgcgccttcgccagtctgggcaccgaaaaagtgcgcctgacaggaggagagccgtctttacgccgcgactttaccgatatcatcgccgctgtgcgggaaaacgacgctatccgccagattgcggtcaccaccaatggttaccgtctggaacgcgatgtggcgaactggcgcgatgcgggacttactggcattaacgtcagtgtcgacagtctggacgcccgccagtttcacgctattaccgggcaggataaattcaaccaggtcatggcagggattgatgctgcatttgaggccggttttgagaaggtcaaagtcaataccgtgctgatgcgtgatgttaatcatcaccagctcgacacctttctgaactggatccagcatcgccctatccagctgcgtttcatcgaactgatggaaacgggcgagggcagtgagctcttccgtaaacatcacatctctggtcaggttctgcgtgacgagctactgcgtcgcggctggatccaccaattacgtcaacgcagcgacggtcccgcgcaagtcttttgccatccggattacgccggagagattggccttatcatgccgtatgaaaaagacttctgcgccacttgcaaccgcctgcgcgtttcctccattggtaaactccatctctgcctgtttggtgaaggcggcgttaacctgcgcgatctgctggaagacgatgcccagcaacaggcgctggaagcgcgtatttcagcggcgctgcgggagaagaaacagacccatttcctgcatcaaaacaacaccggtattacgcaaaacttatcgtacattggcggctaaaacgtcaaaaggagagatcagatgagtcaggtaagcactgaatttatcccgacccgtattgctattcttacggtttctaatcggcgcggtgaagaagacgatacctccggtcactatttgcgcgattcggcgcaagaagcgggccatcacgttgtcgataaagccattgtgaaagaaaaccgctacgctattcgcgctcaggtatctgcgtggatcgccagcgacgatgtacaagtggtgttgattacgggtggtactggcctgacggaaggtgatcaggctcccgaagcattgctgccgttgttcgaccgtgaagttgaaggttttggtgaagtgttccgtatgttgtcgtttgaagagattggcacttccacgttgcaatctcgtgcggtagcgggcgtcgctaacaaaacgctgattttcgccatgccgggttcgaccaaagcgtgccgtaccgcatgggaaaatatcatcgcgccgcagttggatgcccgtacgcgtccgtgtaatttccatccacatttgaagaaataagtatgtcgcaactgacccatatcaacgccgctggcgaagcgcacatggtggatgtctccgccaaagcggaaaccgtgcgtgaagcgcgggcggaagcctttgtcaccatgcgcagcgagacgctggcgatgattattgatggtcgccaccacaaaggcgacgtatttgccactgcgcgtattgccggtattcaggcggcaaaacgcacctgggatctgatcccgctctgtcatccgctgatgctcagcaaagttgaagtcaatttacaggccgagccggagcacaatcgggtgcgtatagaaaccttatgccgcctgaccgggaaaaccggtgtcgaaatggaagcattaaccgcggcctccgtggcggcgctgaccatttatgacatgtgcaaagcggtgcaaaaagatatggtgattggttcggtacgtttgctggcgaagagcggcggcaagtcgggtgactttaaggtggaagcggatgattaaagttctttttttcgcccaggtgcgcgagttggtgggaacagatgcaaccgaagtggctgcggatttcccaactgttgaagcgttacgccagcacatggctgcgcagagcgatcgctgggcgctggcgctggaagatggcaaattactggctgccgtcaaccagacgctggtgagttttgaccatccgctgactgacggcgacgaagtagctttcttcccgccggtaaccggaggttaagatggcagaaaccaaaattgttgttggtccgcagccgttcagcgtaggagaagagtacccgtggctggcggagcgtgacgaagacggtgcggtagtcacctttactggtaaggtgcgcaaccataacctgggcgacagcgtcaacgcattaaccctcgaacactatccggggatgactgaaaaagcactggcagaaattgttgatgaagcgcgtaaccgctggccgctggggcgcgtcactgtgattcaccgcatcggggaattatggccgggcgatgaaatcgtttttgtcggtgtcaccagtgcgcatcgcagcagtgcgtttgaagccgggcagtttattatggattatctcaaaacccgcgcaccgttctggaagcgtgaagccacgccggaaggcgaccgctgggtcgaagctcgggagagcgatcggcaggcggcaaaacgctggtagttttttgttagccggataaggcaccgctgcgtccggcaatttcaccgctcagtacatgcgtttacgctgcgtcgatgcacagcctcatcattttgcagtatccttaagatattcctaatatcttcaggagatcgtcatggacagattcccacgttctgattcaattgtacaaccccgggctggcttgcagacttatatggcgcaagtctatggctggatgaccgttggcttgttgctgaccgcatttgttgcctggtatgcagctaattctgcggcagtgatggagctgttgttcactaaccgtgtctttttaatcggtctgatcatcgcgcaattagcattggttattgtgttatcagcgatgattcaaaagctgagcgcaggtgtaacgactatgctctttatgctttattcggcgctgacgggtcttacgctttccagtattttcattgtctataccgctgcttctatcgccagtactttcgtcgttactgccgggatgttcggcgcaatgagcctgtatggttacaccacgaagcgcgatctaagcggctttggcaatatgctgtttatggcgttaatcggcattgtgctggcatcgctggtcaacttctggctgaaaagcgaagcgttgatgtgggcagtcacctacatcggcgtgattgtctttgtcggattgacggcgtatgacacccagaaactgaaaaatatgggtgagcagattgatacccgcgacacgtcgaacctgcgcaaatattccattcttggcgcgttaaccttgtatctggacttcatcaacctgttcctgatgttgctgcggatcttcggcaaccgccgttaattctttttcaccatcaatatcccggccatgtgtcgggattttttttcttactaaaaacgacacttaacaagtaccaggtataaaatacgccttatggacgagcggaagcgttttccgtatccataaatacaaaagtattttgtatgcgtgggtttaaatttattcatgatgaatattaatattttttctaaggataactaaaagaatggaatcatactcgaaaaacagcaataaattagattttcagcacgaggccaggatattaaacggtatatggctcattaccgctttaggtttggtggcaaccgcaggactagcctggggagctaagtatctcgaaattacggcaaccaaatatgattcaccaccaatgtatgtcgccatagggttattattactttgtatgtatggcttaagtaaggatatcaacaagataaatgccgccatcgcgggcgtaatatatctgtttttactctctttggtggcgattgtcgttgcaagtttagttcctgtatatgccattatcatcgtgttcagcactgcgggcgcgatgtttttaatcagtatgctggccggtttattatttaatgttgatcctggttctcaccgttttatcattatgatgacgttgacagggttggccctggtaatcatcgtgaatgcggcattaatgagtgaacggcccatttgggtaataagttgcttaatgattgtgttatggccaggcattatctcgcatggacgaaataagctccttgaactggcaggaaaatgccatagtgaagagttgtggagtccggttcgttgcgcttttacaggtgcattaacactctattactattttatcggcttctttgggatacttgccgcgatagctataacgcttgtctggcaaaggcatacgcgtttttttcattagtcgtaaatgcagatactaaagaacttaactgaacttcacatcgccgcttcatttttcgctcgtagctttttcgcctggctttccagcaacaggtaacagatcagcgccagcagcagtgggataaagtaatacagcacacggtaagcgagcagggcggcgataattgtgcctttggtgatatgctccccagccagtagcgcgataaacaccgcttccagcacaccaattcccgccggaatatgcacgatgacgcctgcaatactactaaccagcaacacgcccagtacaaagaaatagttaacgctttgaccaagtaacagccagataatcgcccccattaccatccagttaacgctggaaatcagcatctgggcgagggcgaatttccatgaaggcagtaccagcttttgccctttaatggtcatatggcggtgcttcgcgaaagcgcaaaaccacaaataaaccgcgataatcatcagtaagccaatgccgagaatacgcagcgtagtttgatcgacataccagtgatccggcaactccaccacgcctgcggtaaagataatccccgccagcaaaatatagcccagccagttggtggtgatactgagcgagaaaatccgcgtaatagtgctaccgggcaaccccagacgagagtacaaacgatagcgcataccaatgccgccgacccaggtactgagtgtcaggttgaaggcgtagcagataaacgacaccagcatcacctggcgcttcgccagtttgtgaccgcagtaaaagcgggcgagcaggtcatagcagccgtaaatcagataactgacgaccaccagcccgaccgcactgagcagcgcaacgcgattgtagtcacggatgaccttccagacctcttcccagtccacctttttggcgtagaccaccagcaacacaatcaccgcgataaaaaacagccaggtgaggatcttctttgctaagcgccagcgcgggtgtgatttactcatcagggttttacccccgtgttttcagtttctacccgatcctgcgtttccattgtcggttgtgcggggggatcaacctgcgtcagacgtggtgtgtgtgccggaagccagccaaccagcgccgggaagtggcgtaaaaagtggaacgccagcacgcttttggtcaggttccaccaggtgcgtttcggcagcatggtctcatcgacctgctgacaatctgcggcaataatgccgttcagattatcgcgcagcgtctggttaaaatgacgatcgtggatgatgacatttgcttcgagattcagtgacaaactgagcggatcgagattactggaccctactgtcgcccagtgatcgtccatcaatgccactttgccgtggagcgggcggcggcggtactcaaatacctgaacgccgcctttaaccagatagttatacagcaagcgcgcaccgactctgacaatcggcatatccggttcgccctgaatgatcagtttgatccgcaccccgcgccgtgccgctttacgcaaggcgtgtaaaaatcgatagccggggaagaagtaggcgttggcgataatgacttctcgctgcgcctgagtgagcattttcagatagtgacgttcaatatcatcgcgatgttcttcgttatcgcgccagaccagcaatacctgcgcttctcccggctggcggttctcttccgctttgtgatgacgtcgccaccagcgtcgtgccgcgctctgtccaggcaggttttccagctcaaactggagaatatcttcgacaatcggcccttcaaggcgtaccgcgtaatcctgtttagcctctggaccgtagctggacatatgctcggcggagtaattcagcccgccaataaaggcgatacgcgcgtcgatcaccacaattttgcgatgcatccggcgaaacacattggtgcgcataccaaaaaggcgagggcggggatcgtagtagcgaaataccacgccagctgccgtcagttcattgacaaactcatcgctgagatccggcgaaccgtagccatccagcaagacttccgctttaaccccgcgttgcgctgctgccagtagtgccgcatgcagctgtttgccgacgtcatcctcaaaccagataaacgtttcaagaatgatgcgttcttgtgcctcgccaatcgccttaaacaccgcgggataatattgctcgccgttttccagcaactcgatcttattgccttcacgccagctacatttcataaatgaatctccgcacttaaaggggcatgatcagaaaggtgtcgccatgtctgcagcggcaacgcggttggcgcgctggcgctggcatttttgacgtagatcctgtccagacgtagtagaggaaattgcaccggaaacgtgcgcgccgggcgtccgtgggcgcgggtaaatatctcatccagcccggcctgcacttttaacggatgattagctttttgccgccagtcgttgaaatcacccgccaccaatactggttcgccgtccggcagctcattgacccattcggcgagcatcgcaagctgcgcctgacggtgcgcctcacgcaggcccagatgtacgcacatcacatgaatcgcttttccggtcatcggcggcacaatgcggcagtagagcacgccgcgcttttccgcaccatcgaccgaaacatcgcgattctcataatgttcaatgggataacgcgacagtacggcgttgccgtgatgcccttccgggtatacggcattgcgaccgtaggcaaaatcgctccacatagtgtcggcgagaaactcgtagtgcgaggtatcgggccagttttccacatgcagcggatgaacttcgtgcgcgcccatcacttcctgcaggcaaacaatatcggcgctgacggtacgcacggcatcgcgaagttccggcaaaatgaagcgtcggttaaacgcggtaaagcctttgtgaatattgatggtgagcaccttgaacgaaaattgttgtgtttgatcgggcataattttcctgtctttgcctcttatctcattgaaatagtgtagtcggcgtcacaaaaaggtgcggtcttacggaattttccgtaaagttcggtactctgagtaagtagagataaattcttcaggagagaagccatgaagtggcaacaacgtgttcgtgtcgcaacgggtctaagttgctggcagattatgttgcatttactggtagtggcgctgctggtggtgggctggatgagtaagactctggttcacgtcggcgtgggattatgcgcactgtattgtgtcacggtagtgatgatgctggtgtttcagcgccaccccgagcaacgctggcgtgaggtggcagacgtgctggaagagctgaccacgacctggtattttggcgcagcgctgattgtgctgtggctgttgtcccgcgtactggaaaacaactttttgctggcaattgcagggctggcgatccttgctggcccggcggtagtgtctttgctggcgaaagataagaagttacatcaccttacgtctaaacatcgcgtacgccgctgaccctgtcgtggccgttatcaccagtagcggccacaaactattccacacaatatccagactcgcatccttcaaataaatctgcttggtaatgtccgtaaagtggcgaatagggttaatccacgtcaggttttgcagccatactggcatgttttccaccggagaaacgtaaccggaaaggagaatggcgggcatcataaaaacaaacacgccgataaacgcctgctgttgtgtcgagcagagtgatgaaatcaacagaccgaatcccaccagcgataaaccgtaaatcaccatcgtaaagtagaacagcgccagcgatccggcgaaggggatttgatacgcccagataccaatcgccagcacaatggtggcctggaaggtggcgacaattaacgccggtacggctttgccgatgaagatctgccaggtggtgagcggcgaaaccagtagctgatcgagcgtaccttgttcacgttcgcgggcgacggaaagtgaagtgacgatcattacgccgatagtggtgatcatggcgatcagcgacggcaccacaaaccatttgtagtcaagattcgggttataccagttgcgtaccaccagctcgctgttgttaggtttcggttttccttccagcagctcctgctgataatttttgacgatctgttgcaggtagttggcggcaatttgcgcactgttggagttacgcccgtcgaggatcaactgcaacggcgcggtctggaaggtatccagtttgcgcgagaagtcagccgggaaacgcaccagtagtaacgccttttgtgtgtcgatggttgggcggatctcctgtgggcttttcagcagcagcacatgggtaaaggcgctggcgcgggcaaaacgttgggtcagctccaccgaatgctcgccgttatcttcatcgtagatggcgatggtggcgttagtcacttccagcgtggcggcgaacgggaacaggatcacctgaataagcacaggtaaaatcagaatcgcgcgggtttgtggttcgcgcagcaacgactgcaactctttgcggattaacgtccataagcgatgaaacatgctcttctccctaatccagccgacgtttggttttcagccacgtcaggccgataaacatcaccgccgaagcgatcaaaaacagcacgtttaccaccagcaccactggaatattcccggcgaggaacaggctttgcagggtgctgacgaaataacgagcgggaataatgtacgtcaccgcgcggatcaccgcgggcatactgtcgatctgaaaaataaagccggaaagcataatcgacggcaggaacgcggcgttcagggcgacctgagcggcattgaactggttgcgggtaatcgtggaaatcagcagccccatccccagggtactgagtaaaaacaggctggagataaaaaacagaataagcagcgaaccgcgatacggcacgccgagaataaacactgacaccagcatacacagcagcatcgccagcatcccgagaaagtaataagggatcagcttacacagcagcagttccgtgcgggtaatctccgtagagagcagagcctccatggtgccgcgttcccattctcgcgccaccaccagcgaggtgagaatcgcgccgatgaccgtcatgataatggtcaccgcacccgggataataaagtgctggcttatcgccgccgggttaaaccagtagcgggtttgtacatcaataagcggttcaaaagtctgcccgttgtcctccgctcgctgcatttgccagatctgccagatcccttcgacatacccctgtacaaagttagcggtattcggctcactgccgtcggtgatcacctgaatcggtgcggtggcgttggcgcgctccatctgttccgcaaaatccaccggaataaccaccagaccgcgaattttccccgcctgcattttggcgatcagttcctgacggttatcgctgatggtggcgtcgatgtagggtgaaccggtcatggtgtgggtgaaatccagcgccgcttcgctacgctgttccagtaaaatcccgacccgcagcttgctggagtcgaggttaatgccgtaaccaaaaataaacagcagtagcagcgggatcactaccgcaatcagccagctactcggatcgcgaacgatctgccgcgtctctttaacgcacagcgcccgtacgcgacgccaggacagaatcgggttactcattgctatgctccttatcccagtcgtggatcaactgaataaaggcttgctccatggtgggatcgggttgctcgtcgttggccgactgcgctttcaaatcatccggcgtgccgctggcaattaatttcccacggtacaccaggccgatgcggtcgcaatattctgcttcatccataaagtgagtggtgaccatcaccgtgacgcctttctctaccatgctgttgatatgcagccaaaattcgcggcgggtgaggggatcaacgccggacgttggttcgtcgagaaacagaatgtccggttcatgcatcagcgaacaggccagcgccagccgctgtttaaaacctaatggcagttcatcggtcgcgtgggaggcgatacttttcaggccaaatgcctcgctcatacgggagattttttcgttctgcgcccgaccgcgtaagccatacacaccagagaaaaagcgtaaattctgttcgaccgtcaggttgccgtagagcgaaaatttttgcgccatatagccgagatgctggcgcgctttaccggaactctctttcagatccatccccagcaccagcgcctggccggaagtcggcaccagcaaaccgcacatcatcttaaaggtggtcgatttacccgcgccgtttggccccagcaaaccaaaaatctccccacgtttaacggcaaagttgacgtgatcggtggcggcaaaatcaccaaatttcttggtcagttctttcgcttcgatcaccgtctcgccgggtgtgccttctaccgtatgcaatattgcacccagcggcgattctgaggttccggcaccacccagcaaatcaataaacgcatcttcaaaacgcggcgtagtttcgttgatgttgatttccggcatcccgtcggcatggcgaatatcgtctggtgtggcctcttttttgaggatcagacgtaccgatttcccctgaatcatgccgtcgctgacctgcggcagtttcaaggcgcgttgcaacagtttgcggttgccctcgtgtggactggtcatcagaaagctgcgtccggccatggtttgtgtcagggcttttggttctccctgatacagcaactcgccttcgttcatcagtaacacgtcacggcactgctcggcttcgtcgagatacgaggtactccagaggattaacatcccttcgcccgccagctcatgcaccatctgccacagttcgcgccgtgagatagggtcaacgccgacgccgggttcatcgagcagcaacactttcggttcgcccaccagggtacaggccaggccgagtttttgtttcatcccaccggagagcttgcccgccaggcgtccggtaaacggcccaagagacgtaaactccagcaggcgagcaaaagtttgcttacgtgcctcgccggtgacgctgcgcaaatccgcgtacagattgaggttctccatcaccgtgagatcttcatacagaccaaatttctgcggcatatagccgagcacggcgtgcagcgcgccgtcgtttttgatcggatcaaagccaatcaccgtggcactgccgctgtcgggtttcagtaatcccgccaacatccgcatcagcgtggttttacctgcaccgtccggccccaccaaccccgtcacataaccggcgtgaatggtacaatcgagcggcgcgacggcgggcttgtccatgcccggaaagcgtttttccaggccgttcagcgtgataacggcatcattcatgtcctgcctcgtcaccgaattgtaccgtcactggcattccctggcgtaacgcatcatcggcgtcggtcaccacaatacgcaggcgatagacgaggtcggtacgcagatccggcgtttcgacggttttcggggtaaattcagcagtcggcgaaacgaaaccaatctgcccgtgatacggcttgtccgggcgaccatcggtataaagcagcactttgcgccccggctgggcctggtcaagattacgttcatcaacataagcgcgcacccacaccggacgcgttagtgaaacggtaaacaccgtgccaccttcattgaggaccgtgcctggctccaccgcgcgcgttaacagcgtgccatcagacggggctatcaacgttgagtcctgtaaattcaactccgcctgcgccagttgcgcctgcgcctgttcgaggctggctttcgcctgagcgatgtcctgttcacggttaccggaacggtactgacgcaatttatcctgtgctgatttcagcgttgcctgcgcctggtcgcgcgaggagcgggcattttccaggtcatttgccgaaatagtgcggcttttccacaacccttgctggcggttatagaagttctgcgcataatcataggcggcttgcgcctgtttcaccgctgcggcggcctgagcgatttcttcatcgcgatacccggcaagcatcaggtcatactgcgcctgtgccaccgaaacacccgctttcgcctgcatcagggcaatctcatacggcttgtgatccagttcgcccagcacctggcccgctttgatagcatcaccttcgtccaccgccagcgattcaacgcgccccccaacacggaaactaagatttaccgtacgaatatccacgttgccatacagcgtcaggccgttatcctggcggctttgataccaccagtagcctccggcaaccacggcggcaagtaccactaccgccaatccgatcacgacaggttttttcatcactacaaactcctttgcgataatccttgcaaaatcaggtcgatatgacaggtcaccgtctggttgatcagttcggtcttttcttcatcgaacgcggtccagccggtacgtaacagaattgtttctttgccaagacggaacgccagaatctcaccaatcaacgcatgggtatgaaggatcatgcgggtgtcattggcgtcgcagccggtccaggcggcaatcaggcgtgtcaggtggctgtgtagcggactaatcacctgttcgtgcaccaggtggtaggctgccgtgggagagagctgctcacgggagataaacttgctgaggttgacggtgtcatcctgggtgagcagcttaatcatgttcctgcaggcgcgaaggatcagttcacggatggcagcccgatcaggctgtggttgcgcgaacaagcgttcggcttcctcggcatgcggacggaactgctcgccaataaaatcggcaatccactgggcgcaggcgaggtacaaatcttctttcgaaccgaagtagtaggtgatggcagcgatattctgcccggcctgggcggctatctcgcgagtggtggcgttcattccatattcaccaaactgcgccagtgcggcagcaatcagctgttttttcgcctgttcacccttgattgtcatggcaggattattcatcgcacagtccattcttaatcaaatgattgattaagattatgactccataggggagttgtccagtatggctaagaattttagcaacgccagtcacagggataatttatgcgctgcgtcacaaaaactgctacactccgctccctcatgacattgtggtttttgtcattttccttttcagtatctccctgaaaactacaccggtaacggtcggggcggttcggagtagttatgtctttcgattctttgggtttaagccctgatatcctgcgcgccgttgccgagcagggttaccgtgaacccacccctattcagcagcaggcgatccctgcggtgctggaaggccgcgacctgatggctagcgcccagaccggcaccggcaaaacagcgggctttacgctgccgctgttgcaacacctgatcactcgccagccgcacgccaaagggcgtcgtccggtacgtgcgctcattcttaccccgacccgtgaactggcggcgcagattggcgaaaacgtccgtgattacagcaaatacctgaacattcgttcgctggtggtgtttggtggtgtgagtattaacccgcagatgatgaaactgcgtggcggcgttgatgtgctggtggcaaccccgggacgtttgctggacctggaacatcagaatgcagtgaagctggatcaggttgaaatcctcgtcctcgatgaagctgaccgcatgctcgacatgggctttatccacgatatccgtcgcgtgttaacaaaactacctgcgaagcgccagaacctgttattctccgcgaccttctctgacgatattaaagccctggcggaaaaactgttgcacaacccgctggaaatcaaagtggcacgccgcaataccgcgtctgatcaggtgacccagcacgttcactttgtcgataagaaacgcaaacgcgaattgctgtcgcacatgattgggaaagggaactggcagcaggtgctggtgtttacccgtaccaaacacggcgctaaccatctggctgaacagctcaataaagatggcatccgtagtgcggcgatccacggcaataaatcgcaaggtgcgcgtactcgtgcgctggctgattttaaatcgggcgatattcgtgtactggtggcaactgacatcgctgcgcgcggcctggatattgaagagctgccgcacgtcgtcaactatgaactgccaaacgtacctgaagattatgtccaccgtatcgggcgtaccggtcgtgcggctgctaccggtgaagcgttgtcgctggtgtgtgttgatgaacacaaactgctgcgtgatatcgaaaaactgctgaaaaaagagatcccgcgcattgcgattccgggctatgagccggacccgtcaatcaaagccgaaccgatccagaacggtcgccagcaacgtggcggcggcggtcgtgggcaaggtggtggtcgcggtcaacagcaaccacgccgtggggaaggtggcgcaaaatctgcaagcgcgaaacctgcagaaaaaccgtctcgccgcctcggcgatgccaaaccggcaggcgaacaacaacgtcgccgccgtccgcgtaaacctgccgctgcgcagtaatcttttatgccgggctatgcccggcatcaggctgatgaacaaacgcaaaactgcctgatgcgctacgcttatcaggcctacgtgaactctgcaatatattgaatttgcatgcttttgtaggccggataaggcgtttacgccgcatccggcatttcacaacaagcacttgtcagcaatttgagaacacgggaaaaaatttatctgttttaccgcccataagccaccgagacgttacttctctatagccaattgttcgcgcaactccattaaaaggtagcccagtcgattcttgcccttaccatgaccaccgtctccccagtaagcatcgttttccgtatgctcaaccagttttgcgggcgcggttgccagcaagagcgcacgcagttctgcatgctgttcgaatttagcgcgaagtgcttttcgcatcacctgttctttgaccgactcccagtttttacgcagaggcttagaacgatcgcgccccatgcgtgcggcgaccataggggaagaaacccgacggatctcttcgcggtatttttcatcaaggaatttttgtgcctgaaaatagtgttctgaggtgggccaggttttcccgtcaaccttgatgggccaggcggcaaagttagaaaaatcaccgtagtcatcgctggtgctgtagaaatttatgatggtgtcttgcatgacgtgttggatcctttgtgctcgaacgggcattaaaccgcattatgttggtggttattgcgagccgctttccagaaacagaaaaaccattacccctgaaaaccgaaaaatgccacaatattggctgtttatacagtatttcaggttttctcatggcattaaccgccgcgcttaaagcgcaaattgccgcctggtataaggcgcttcaggaacagatccccgactttattccccgtgcgccgcagcggcagatgattgcggacgtcgccaaaacgctggccggagaagaagggcgacatctggcgattgaagcccccaccggcgttgggaaaacgctctcttatttgattcccggcatcgccattgcccgcgaagagcaaaaaacgctggtggtgagtaccgccaacgtggcattgcaggatcagatttacagcaaagatttaccgctgctgaaaaagatcattcccgatcttaaattcactgccgcttttgggcgtgggcgctacgtttgtccgcgtaatctgacggcgctcgccagtactgtacccacgcaacaggatctgctggcgtttcttgacgacgaactgacgccgaacaatcaggaagagcaaaaacgttgtgcgaagctgaagggcgatctcgatacttataaatgggatggtctgcgcgatcatactgatatcgctatagatgacgatctctggcgtcgtttaagtaccgacaaagccagctgcctcaaccgcaattgttactactatcgtgaatgcccgttttttgtcgctcgtcgggagattcaggaagcggaagtggtggtggcaaaccatgcgctggtgatggcggcgatggaaagcgaagcggtattgcctgacccgaaaaatttactgctggtgctggacgaaggccatcacctgccggatgtggcgcgggatgcgcttgagatgagcgccgaaatcaccgcgccgtggtatcggctacagctggacttgttcacgaaactggtcgctacctgcatggagcagtttcgcccgaagaccatcccaccgctggcgatccctgaacgtttgaatgcgcattgtgaagagttgtatgagcttatcgcctcgttaaacaacattctcaatctctacatgcctgccgggcaggaggcagagcaccgttttgcgatgggcgaactgccagatgaagtgctggagatctgccagcggctggcaaaactcaccgagatgctgcgtggcctggcggagttatttcttaacgatttaagtgagaaaaccggcagccatgacattgtacgtctgcatcggttgattttgcagatgaaccgcgcgttggggatgttcgaggcgcaaagcaaactctggcggctggcttcgctggcgcaatcttccggtgcaccggtgaccaaatgggcgacgcgggaagagcgcgaagggcagctacacctctggtttcactgcgtgggaatacgtgtcagcgatcagctggaaaggctgctgtggcgcagtattccgcacattattgtcacctccgcaaccttgcgttcgctgaacagtttttcgcgtttgcaggagatgagtggtctgaaagagaaagcgggcgaccgttttgtggcgctggattccccctttaaccactgcgaacagggcaaaattgttattccccggatgcgcgttgagccttccatcgacaacgaagagcagcatattgccgaaatggcggcctttttccgtaagcaggtggagagcaaaaaacatctcggtatgttggtactgtttgccagcggacgggcgatgcagcgctttctcgactatgtgacggatttacgtctgatgttgctggttcagggcgatcagccgcgttatcgtttagttgaactgcaccgcaaacgcgtcgccaacggtgagcgcagcgtgctggtgggcttacagtcatttgccgaagggcttgatttgaaaggtgatctgctcagccaggtgcatatccacaaaatcgcttttccgcccatcgacagcccggtggtgatcaccgaaggggaatggctgaaaagcctcaaccgctatccgtttgaggtgcaaagcctgccgagcgcctcgtttaacctgattcagcaggttgggcgactgattcgaagccacggttgctggggcgaagtggttatctacgacaaacgcttgctgaccaaaaattatggcaagcgactactggatgcattaccggtatttccgatagagcaaccggaagtccctgaaggtatagttaaaaagaaagaaaaaacgaaatccccacgccgtcggcggcgttaatgatgtgagtcaggtaaggagtcgtaaatggactatcgcaaaatcattaaagagatcgggcgcgggaaaaaccacgcgcgcgatttagaccgggatactgcgcgcggtctgtatgctcatatgctcaatggtgaagtccctgaccttgagttgggcggcgtattgattgcgctgcgtatcaaaggagaaggggaagcagagatgctcggcttttacgaagccatgcaaaatcacaccatcaagctgacgccgccagcaggcaagccgatgccgattgtcatccccagttacaacggcgcgcgtaaacaggccaacctgacgccgttgttggcgattctcctgcacaaactcggttttcctgtggtggttcacggggttagcgaagatccaacccgcgtgctgactgaaaccatttttgaattgatgggtattacgccaacgttgcacggcgggcaggcgcaggcgaagctcgacgaacatcaaccggtgtttatgccagtcggcgcgttttgcccgccgctggaaaaacaactggcgatgcgctggcggatgggcgtgcgtaacagtgcacataccctggcgaaactggcgacgccatttgccgaaggtgaggcgctgcgtctttccagcgtttcgcatccggaatacattggacgcgtcgcgaagttctttagcgatatcggcgggcgggcgctactaatgcatggtactgaaggtgaagtgtatgctaatccgcagcgctgcccgcagatcaatctcattgaccgtgaagggatgcgggtgctgtatgaaaaacaggacactgctggtagcgagttactgccacaagcaaaagatccggaaaccacggcgcagtggattgagcgttgccttgctggcagcgaaccgattcccgaatcgctgaaaatccagatggcttgctgcctggtggctacgggtgaagcggcaactatcagcgacggcctggcgcgcgttaatcaggcattttaattcttttctcagccggatgagccatgtcatccggcttttaccccaccgcaatatgaaattcctgcatctttattgaccttcccacgcccggcgtgcagcataaaaatacaacaaacacataacataaacaggagttaaccatggaaagtggtcatcgctttgatgctcagacgctgcacagttttattcaggctgtatttcgtcagatgggtagcgaggaacaagaagcgaaattagttgccgatcatttaatcgcggcaaacctggcagggcatgattcacatggtattggcatgatcccaagctatgtacgctcctggagtcaggggcacctgcaaattaaccatcatgccaaaaccgttaaagaggcgggggcggcggtcacgctcgatggcgatcgcgcatttggtcaggtcgcggcacatgaagcgatggcgctggggattgagaaagcgcatcagcacggtattgccgccgtggcgctacataactcgcatcatatcggccgtatcggttactgggcggagcagtgtgcagcggcggggtttgtctctatccactttgttagcgtggtcggtattccaatggtcgcgccgttccacggtcgcgacagccgctttggcaccaatccgttctgtgtggttttccctcgtaaagataatttcccgctgttgcttgattacgccaccagcgccattgcatttggcaaaacccgcgtcgcctggcataaaggcgtccccgtgccgccaggttgcctgattgacgttaacggcgtgccgacgaccaatccggcggtaatgcaggagtcgccgttgggttcgctgttgacctttgccgaacataaaggctacgcccttgcagcgatgtgtgaaattcttggcggggcgctttccggcggtaaaacgacgcatcaggaaacgttacaaaccagtcccgatgccattcttaactgcatgaccactatcatcatcaacccggaactcttcggcgcgccggattgtaacgcgcagaccgaagcctttgccgagtgggtgaaagcctcgccgcatgatgatgataagccgattttgctaccgggcgagtgggaagtgaacacgcgtcgcgaacggcagaagcaggggattccactggatgcgggaagctggcaggccatttgtgatgcagcgcggcagattggtatgccggaagagacgttgcaggctttctgtcagcagttagccagctaaaaaaaagcccgtccagtggcggacgggcaaacaagggtaacataggatcaatgagggttagagcatatgcgtctgtcggcaaacagacagggaaatacttgtgctggacgtagcgtaaacgcctgatccgtccaacggttcggattttgtaggcctgataagacgcggtagcgtcgcatcaggcatctgttgccggatgcggcgtaaacgccttatccgtcctacgaattacttataaattaccgcagtaccgcttaatttattgttgttggtggcggaagtgatgctgtatccactggcaccggctgccgcggctttctcagccagtttcgcttccagggcatcgagggtggatgcgccatcggcagaaaccacgccgattttattcatgttctgtgcctgggatgccgttaccggttccgccgcgaacacgccaaatgacagagttgaaagagccatagcagcaacaacagtattgatagttttcataattaatctctcgcaggtgatttttgtataagtgacgttgtttcgtcgatgtgatgagtatcacgtttttttacgagagataaaatcgaagagaattgaccgccttgttcaaataaattgattgatatctaacctactgataaaccatttatttgttgtacttatgaacttgttttataccgcgtggcagtcacagcagcgttaaaggcacggaatgccacgcaaaatacaaattatactcgctatgcatctcgccagttgtagttaacgtaactggctgtctttcgaacctctgcgattatatcctgtataagctggtttttgtaaatctttctcctgctgacaatgaatacataagcgcacgccaggaatggcttcccgacgggcctgcgggatgggggcaccgcactcttcacattcatccaggctttcgccgcgcggaatttcaccccgagcacgggcaatcgcatcttcaattgtactgttgatctgttcgttgacggcgtcatcgttagcccaaccggatgccatatcgacctccccatatcaatacttgtacagttaagtgtagctaatccagggacgaactcgggcagttcaagcatcagatctccgaccattcccgcagcagattatgataaagattaagcagcgacaggatctcttcactttcgccgtagcggcttttcagcgactgaatattgttgtccagttcaaacagcatggcgcgctttttatcatcgcggatcatcgactggatccacataaatgatgccactcgtacgccgcgggttacgggtgtcacgcaatgcaggctgctggagggatacaacacgagatcgcctgccgggagttttacccgatgttgtccgaaggtgtcattaacgaccagttcgccgccgtcgtagctttgtggatcgcttaaaaacagcgtggcagaaaggtcagtacgcatccagccgttttgtggatggctgcgtactgcgccatccacatggaaaccataggtttcattgttctgatagcgattaaacagcggcgtggaaagggtacgcggcaaggccgcggcaaagaataaagcatgttggttaaccgcgttcagcacctcattttgcagggcggcgtataacgtgctgcgggtgtcgacctgttgattgttcttaacttgcgcaccttgtgcgccggtggtgacgcgtccatccacccattcggcttgttccagttgttcgcgaaaacgagcgacgtcctgtggcgataacacgccgggaatgtggtacatcatacaatttctccaaaaagtggggcctgcgccccacatctgattcagaaatgcatattggctgtgagcaagaaggttcttggctcgcccgggtgataacggtagccgctcttgttgattgaggcgacgtaatcggtatcaaacaggttgtaaacgtttagctggaagtcgagattgcgattaactcgataccccagtttggcatcggcgacccagtaaccttcggtaaacgctggcgttcccaccgcgccgtctgaacctttatgcatactgccgatatagcgtgcgcccgcgccaacagagatatcgtcggttgcctgatattggctccataaggtgaaggcgtgctccggggtatacggcagcgatgaggaaccatcctgggcaacatctttgccgtttttgatggttgctttttgctgggtatagccgccaatcacctgccacgcgggagtgatattcccggccacggatatctcatagccttcgacgcgtttcttaccgtattgcgagtaagttccgtcatcattttgctcaacttcattttcgatatcagtgcggaacagcgcggcggtgagcaacagacgtttatccagaacctgccatttggtgccaatctcgctggtgttggctttttgcggtttaaaatcggtgcggttggcactgttaccgctgccagactgcgcaagggcgaagttgttgccgcccggaggctgctgggaaacggcatagttaatatagacattgccgttttccgtcaggtgatacagcgccccggctttccagttcatcagattgcccgacttggcggtgtcgacggtggtgaccggagaaccttttgccacaccagttgggcaggtgatggcaccgcgtccgctgccgccgcaggcggtggcactgtcatattcagtatgataattatccagacggatcccgccgttcagctcaaaatcacgggtgatttgcagcgtatcaaaggcgtaaattgcgaaggtatccgtctgaccattggcgtttgcgccgttgcgcgtcaggccgccgggatgaatgctgctgtcaggatgataaatatttaccgcgggtaacgtcaccggattaacgccgtagttagtctgcgtttcacgggtaaattccacgccggtactgacatcatgaccgatagaaccggtatagaacgtcgaggtcaggttggtctggttggtgagaattttattactcacatctttggtattcgccgtgcgtgaccaggtccagctattcacatcgctggtgggctgagtaatattcgacgccccgcccataatcgccgtcatcaggtaatcctgctttacgcgcgaccaacgggtagtattgcgaatggtggtgttatcgttgatgtcgtgctcaaaacgcatggtggcggtgtcggtggtcgaatcgtcgtaatcggaatccgtgccgtaaaagttatgagtatcaacttttccggaatgattcagggccgccgttcccgcagatggggcagaatagcccggcaaaccgatggtcggaatgccgccgtctggcgtgttgtgctgggtgacatgcagataattaagatacaaacgattcgctgtaccaaggccaaaagcgacagaaggggcgacgccgtaacgctcatttttgactttgtcgcgtccggcatcgtgcgttttttcgcccattacattcaggcgcaccgcggtggtatcaccaatgacctgattgacgtccagcgtgccgcggcggaaccaggcgctgccaatactggcggaggcgtcaatgccggaatcattgcgcggctgcttgctgatcatattgatcgagcctgtcggtgcgctgcgcccgtagtcggtgccggacggccctttaatcacttcgacctgctcggtattgaaggtgtcgcgcgagacgctgccgatatcgcgaatgccatcaatataaatactgttagaggtatcggcaccacgcatataaatggcgtcgccagtggtggagttaccgttctcacccgcaaaaaacgcacccacgccggggacgtttttgagcgcgtcggtaaggttggttgcgccctgatctttaatcacttgttcagaaattaccgtcatcgtgcgggtagtatccgctaccggacgcgagaatttcggatcggcagattgttgtggcgcataaagcgaaggcgttgatgcttcgacaaccagcgtgtcatccgcgttagtttgcccttcggcggcgagtgcctgagccacaggcgtgatgccaatacaaagaccggcaaagaacgtgagcgaatgaaattgtctggcagggaaattgcgattgttttccattttgcaggtgactttttcttatatgttgaaattttcactgccacaagaaagcatctctgcggatgcgatgccactgttaatcccgtgatagtgttcgtgcaagtgataataattttgataagcattatcacttggagcgattttctatcacccattgcgcgaaaaagaaatacatttatttacattgagttcatatttgatgttttttgattacaaaacagacgaaaactgcatccagaggcgaatgcagttacgttggtggggttatttgtagatggttgcagtaccgaacatctggtcatttccgcctgcggaattaatgacataacctttcgcgccttgttcgcgcgctttttctgccagtttatcctccagatcgcttaggtttgatgcgccagttgccgaaacggtaccggcgggccgtagctgaccgctgtccaggttactcatcggttgcgcggcataagccgtgagagagattccgctcaggacggtggcaatcagtagtgtgaggcactttttcataatgacatcctcataaatacaacgggtagtgcctgataagtgtaggtcgcctgcgcgatgcaaatgacgcaaaaaattgacagagatgtgcttattttttgaacgatatatttttacaaaataagacaaatcaatgacatgcataatgctgatttttatgatgaattgccataaaccatagccatgttaaggttttggggaatgataaacgcagccagatatttaccctgtcgcgttatgcgggtatcttacgccgctgcttaaaggagaatgctatgtccgcccagaaaccggggttgcatccgcgcaaccgtcatcacagccgctacgatctcgccacgctttgtcaggtcaatcctgaactcaggcaattcctcacgcttacacccgccggggagcaaagcgtagactttgccaatccgctggcggtgaaggcgctcaataaggcgttgctggcccatttttacgccgtagcgaactgggatatccccgacggttttctctgcccaccagtaccgggccgggcggattatattcatcaccttgccgatttactggcagaagcaagcggaacaattccagcgaatgccagcattctggatatcggcgttggtgcgaactgtatttatccgctgattggcgtacatgaatatggctggcgttttaccggtagtgaaaccagcagccaggcgttaagcagtgcgcaggcgattatcagttctaatccggggcttaaccgcgccattcgtctgcgtcggcaaaaagagagtggggcgatttttaacggcatcatccataaaaacgagcaatacgacgcgaccttgtgtaacccgccattccacgattccgccgctgcggcacgggcaggtagtgagcgtaaacgccgtaacctggggctgaacaaagacgatgcactgaactttggcggccagcaacaggagttgtggtgtgaaggcggtgaagtcacctttatcaaaaagatgattgaagagagcaaaggcttcgcgaagcaggtgatgtggtttacatcactggtatctcgtggtgaaaacttaccgccgttgtatcgtgccctgacggacgtgggcgcggtgaaggtggttaaaaaagagatggcccaggggcaaaagcagagtcgctttattgcctggacctttatgaacgacgagcagcgccgccgttttgtcaatcgccagcgttaaagcgttggttcccccggcggtaacggttcagccggggtcgcgcccggagcaggcagcacctgataagtctgcactggcgcgcgaacgcccgccaggtcgaaatgttttttcacctggctgtcgagggcaaagcgtaccgtccactgtttgagtggcagcgtggtgaacgaaacacgcagtgtaaacgcggtattgcttaagccgacaatcccggcaaaattcggttcaccaataatcagcccgcgaatttcttcgttttccattaattccgctaccgcatctttcagtgcctgattggctttatcagcatcttcatggcgatcaacatcataatttgccaccaccgaaccaatgccgcggacaaagttagcaaaggtggttatcgaagaccacggaatgatgtgatacgccccggtatcctggcgtacgcccacggagcgaatcgacatccgttccactgtgccggtcaacggcccgatagtcaccaaatctccagtgttcatgccgttttcaaactgaataaataccccggtgataatatctttcaccagcgtttgcgaaccaaacgagatagccagacctaatgccccggcacctgccagcaatggcgcgatattgacgccgatttccgacaacacaatcatgatggtgatggtactgataatcaccgccagcgcgttacgaaacagcgtaagcagggtacgcgtgcgggcgctgggtagcgggcggccatgaatatccgaagccagccggttttcgaacaaactggcgagcaccgtccagccaaccgccgagaagaaaagaatgagtgcgatacggatcaggatatctacggttttctgccccgcgccgttttgcagccagttccagaaatcgaacaatccccatgcgctcaacagcaacattaccgccacgcagactgtcagaatacgcgccgttttcagcgccgccgacagccagccattcaaccgtttttgcagctccggatagttacgctgagtatgtggcgagagagtgatggttttcgccagccagcgggaaaacataccggaaacaaacgctgcgataccaataatcgccaggctgcgcaccgttgcacccatcataaatttcaggctgttgcccggatcgaacaacgaaaagaaaaacagcacgataaaataggcgcttgccagccagtgccacaccagcgcaaaggcgcggataaacaggctgaaaaaggccagcgaatgctccgcgaagttgagcaaatgctgggtaatctcttttttattacgaaagatcaggtacaacgcccagacggtcatgcacagcataatgatgacgttcgccagcgcacctatctgtacattcacctgattagagataatcggcacggccacaatcaggccataacctatcaaactgcttaaccagctcaggcgacgactccagtaacgggcgctctcgtcctgaatcgtgaacgggcgcagctccgccacgtttgggcaaaaaatcaggcgtagtacggctttgaaaaattcaatgagggcaaaggcgttgagaaacaaactttgttggaaagcgatggtgcgactgcctgcattcaggttgtcgcttaatacctggccgacaaataatgtcagggccagtaacagcaggtcgataataaacgccccgataatcatcgccggaagctgcaaccagttgctgcgctcacgatttttttgccgcgcccactgacccattttgcgatacagcggcagtgcgcacaggcgaatcagccagtaaaaaccaaacactaataccgctaacattgaaaaatgggtcagcgcattgctgaaggtttgtggattaaacggcttatgcggggagccggtgatattgcgataaagttgcccgaagcgggcggaaagggcttcaccataatggcggctgacttcggtgaccttttgcagcacggtttgctcttcgaccagcgtcggcggcactatttttggtaccggttcagcagggggcgtagcggcaacggtgcgcaactggtcgatcaactctttacgcgaggtgtcattatccagcacatccgccagtgcgccataggccgcttttttttgttcgatatccggttccggggccggttcagtcgttgagtccgttgtcgttgtggttgtaacgccgggtatggataccgcgtgggcaggtgcgcccagcaggcagaagaggatgaacaggatccaccgcatgactcctccagtgagaaaatagagcaaaaagataagtatagatgctggaggaggggcgattttaaatgagaggaatctggtgtgcctccctttcgggtgaaagggaggaagggatattaagcaggttgctgacaacgtgcgggcttttttgccggatgcggcgtgaacgccttatccgtcctacaagttcatgcaattttaataagttgccagatatcctgtaggcctgataagcgtagcgcatcaggcaatgtgtcttattaagagacgtgctgcaaaaattcctgcaagcgctggctcggcgggttcttgatcaacacctgcggattgccatcttccgcaatccggcctttgtcgataaagatcagccgcgaagctactttctcggcaaaaccgatttcgtgggtcacgatcaccatcgtcatcccttcttcagccagatcctgcataaccttcagcacttcatggcgcagttccgggtcaagagcggaagtcggttcatcaaacagcatcattttcggcttcaccgccagcgcgcgggcaatcgccacacgctgctgttgaccaccagaaagttcggaagggtagtgatgtgcacgttctgccagaccgactttcgccagcagctcacgtgccagtttttccgcctcttctttgttcgcgccacgcacgcgtagcgggccaaacatgacgttttccagcgccgtcagatgcgggaagaggtaaaactgctggaacaccatacctgcttcctggcgaatcaggcgctcgtcaactttcggatcgttaaccttcaggccatcgacaatcagatcgccggaggtgatttcttccagtttgttgatgcagcgcagcagggtcgatttaccggaaccggacggcccgataatcaccacgacttcgccctgggcaatgttcaaatcgatattgtgcagcacctgggttgggccaaagtgcttggagacgtttttaaattcaatcacaggattttcatccttctttccagacgacgcagaataaagctcagcaccagggtaataatcagatagaacaccgccacggcgctccagatctcaagggcgcggaagttaccggcaataatttcttgcccctgacgggtcagttccgccacgccgatcacaataaacagcgaggtgtctttaatgctgatgatccactggttacccagcggcggcagcatacgacgcagtgccagcggtaaaatgacgtagcgaatggtttcccaacgtgaaagaccgagcgccagtcctgcttcacgaaaacctttgtggatagacagcaccgcaccacgcgtgatttccgcaatatacgcgccggagttgatcatgatggtgaccaccgccgcagtaaatgggtcgatgcgtaagtcgttaaacgccatcggcagggcgaaataaataaacatcacctggacgacgataggtgtgccgcggatcacttcaataaagaccagcgcgacgtggttggctatccaacctccgaaggtgcgtgcaaaacctgccagcaatccgattaccagaccgcctgccagaccgaggaccgaaatccacagggtcattttggcaccttcaatcagaagcggaatggcaggccagatggcactccagtcaaactgcatatgttgttcctgttaccgtggtgtaaataatcaaattcagggtaattaatggccccggagcgggtttgcgcccctcaccctaatcctctccccataggggagagggaactgccagtgcgttttacaggtgtagcgttattatttcggttcagtaccgaaccattttttgtagatttcgttgtaagttccgttctcgcgcagggttttcaacgcgccgttgactttgtcacgcagctcgtcgctacctttcgggaacgcaataccgtattgctgcgcttccagagagtcacctaccgctttgaactgaccgttaccggcggttttgatgaagtacagaatgtttggcgtatcgtgcagaacggcgtctgcgcggttggtgcccagttccatataggcgttatcgatgttcgggaactgacgcagatctttagttttgatgtttgctttcgcgtaatcaacggagccagtaccgctcttcacagcaaccactttcccgtcgagatctttcacgcttttcacatcgttattgttagctttcaccatcactaacaggccgcttttgtagtagccgtcagagaaatcgatcgcttttttacgctcgtcggtgatggtaatgcccgccagcgccagatcgacgtttttggtttgcagtgccggaatgatcccactgaaatccatcggcttcagttcgtaatccagcttcagctctttagcgatggcagcccacagatcaacgtcaaagcccacatatttatcgccctgtttaaattcaaacggaacgaaggcggtatccgtcgcgacaactaattttttatccgcggcatgagaagaaaccgcaaaagccagggtcagtgcagccagtgaaacttttaatacagacttcatagcatttccttttttctatccacgggacgatcccctgcgtgacattcacatatatgaaaaaatcgtgccagttttgcaactccttgatttttcgagatgcggcaaaaacgtgatgcacgatttatagggcaataccctgaagatgcaccattctggggcaccaatctggtgcgctaaaattgtgcactcaacacagtgattatttagcgtaaaacctgatgaaaaaacaatctttatgtaacgattgtgtgatgatgtggatacaaaaaatttacttaatcagctggagatagcagatggatgcactaaataagtgcgttgaggtgggctgcaaaacaaaacggcctcctgtcaggaagccgcttttatcgggtactaaagttctgcaccatcagcgatggatttattcgatgttagactcgataaaccacaggaatttatccaggtcgcgagacgcggcggtcaggatatctgcggtgtcgtcatctttcgcttcgccaatcgctttgcgtacgtcattagcgacgattgcgtaacggtcagccagttctttcaggtgatcctgaacgttgtggatgtccagcgggtaacttttcagcggggttttgctgttgataacttgagtggtccccagagctacaccgcccagctgcactgcacgttctgccatggtatccagatgatcgatcagtgcggtgcggaagccatccagcatttcatgtacggcaatgaagttagcgccgcgcatgttccagtgcgcttgtttggtaatcaaagaaagatcaataaactggataacctggcgattcagcaactctactgttgcttttttctcgctgtcggagacatcgttgcgggtataaagcagattggtcgcttttgatttaactaatttagcggtactcataatttcatatcctcttgatgttatgtcccagtaattaacgagactaagtatagcaccggctatgtgttccgctattctggctgttcctatcacactaatagtggtaacaagcgtgaaaaaaaaactaataaagattcaatgagttagatatattgataagaacaattcttatttatctgctcgccaggaattttcggaataaatatgcttttgcataattcgatatataaagacggtgtagaggaaaagtagcgagaaattctgcatggttatgcataaccatgcagaaatgtaaatttaattaatgtctaattcttttattttgctctctttgcgtactgtcagcgtagaccccattgaagcggcgatgatagcgccgagcgccagtagctgtatgggtgtcagtgtttctccgaggaaaatcatcccggaaacggcagccagcgccggttccatgctcatcagcgtaccaaatgtccgtgttggcaaacgggtgagggcaatcatttccagcgaataaggcagagcggtcgagagaatagcgacagccagacccaatggaataaccgaccagtgccagagtgcttcaccagcctgaagcgctccaattggcacgaaaattaacgctgcaatcaacgaaccaattgccaccgtcgcagggccatgttccgctcctgcgcgttgcccacttaaaatgtaaatagcccaacaagccccggcccccagtgccagcgcacagccggttaaatcgacatgggaaacgtcttgccccagcggtagcaggaaccacagaccaagaaccgccagcacaacccagacgaaatctaccgggcgacgagaagagaacagcgccaccgccagtggtccggtgaactccagcgccaccgcaatacccagcggtactgtctgaatagaaagataaaaaagataattcatcccacccagcgaaacgccgtaaaacaacagcggtaaccgttgctctttggcaaagcgcagtcgccatggcttaaagaacgcgatgaggatcagcgttcctaatgccagacgcagcgcagtgacacccggtgcgcccaccagaggaaaaagtgacttagctaacgaggctccaccctgaatagacgccatggcaacgagcaatatgactattggtaaccagaccggcattttacgtaatgaaccaggcatcctttctcccacaaatatctagacttaagtaaagcgtggagtgtactggatatacccaatgctggttgagcatttgttgaaaaaattttcccccgttttgactaaaatgcgccaggattgatggaatcattagtctggtgattaggaataatctggatgaatgacagggaaaacatgcgtaatacttacgcagttctctgaaaaagtgatttaaatttagatggatagtggtgtatggaaacgttctgttacatgaaatggcccgttagacatcacaaatcgcgaagagtttcccattaatttttgatatatttaaaacttaggacttatttgaatcacatttgaggtggttatgaaaaaaattgcatgtctttcagcactggccgcagttctggctttcaccgcaggtacttccgtagctgcgacttctactgtaactggcggttacgcacagagcgacgctcagggccaaatgaacaaaatgggcggtttcaacctgaaataccgctatgaagaagacaacagcccgctgggtgtgatcggttctttcacttacaccgagaaaagccgtactgcaagctctggtgactacaacaaaaaccagtactacggcatcactgctggtccggcttaccgcattaacgactgggcaagcatctacggtgtagtgggtgtgggttatggtaaattccagaccactgaatacccgacctacaaacacgacaccagcgactacggtttctcctacggtgcgggtctgcagttcaacccgatggaaaacgttgctctggacttctcttacgagcagagccgtattcgtagcgttgacgtaggcacctggattgccggtgttggttaccgcttctaatcactttggtgatataaaaaatccgcctctcggggcggatttttgtttttaaggtttcgggtcgaaaatatcggttccgagatggttgtaatccaccttctgtaactggaagttggtgatgtatatcggcccggctttcttctcagatataaacgggtatttgatgttaatttccttcgctttaatccccgtccactgggagaaaaagcctaagaagtcattggctgagcggcgggctttaatcacacgatgcgctttatcgtcgctggaaatgaccataaaaggcacctggaaattttgctgatatttatcatcatgggcaaggtattgcacgtctttaccgcgctctttaaaggccagaccgtggtcagaaaagtaaaccagcgagaagctgctgccgctgttgcgtaactgatcgtacagcttgcgcagtaaatcgtccgtttgcgtcatggtatagagatagcacgacgtttctttcgattgcacaaaggtttcgtattttccttgtgtcctgtcgcaggcctgcggatgtgagcccatcagatgtagaacaatcagctgcggttgcgagtgctcttgcgccagcacttgagcggtcatatccagtaacgcttcgtctttggtgtttttatctgcttcaaaattaccttctttcaggaagtacacttcatctgctcgtttggcgatgctggcgatagcggtatcgtattcgccgatttgaccctggttggaaaaccaccaggtctggaagcccgcgcgatttgccagggtgacaaagttatcctgaaactgtggtttgccatcgacaacgcgattgagcgttaagccaagcgatttctgcgtggagccactggcggcaatgtagtcagcaaatatcaaaccgttaacgctgctggcaaacggggtattgtcccagtgaccgccaaaggcaccgagggcatcgcgacgcgcgctttcaccgatcaccaccacataggtctgatacttcggcttaacggcagtgaccgtccaggtatctttcattccggaaagttttgccatccgttcttgctcttcaatcacctcgttattattgacgatgacatccttagcaaaacgaaataccggatagccagtatctttcagtttaaatacgccaccccaggccaggttttgcacgggagcaacaaaaaatgtcgccacactgaataccagacacaggctgtcgaaggtattccagcgcgctttttcattctctttttttcgcctgattgctattacgccgagcgcaaaaataaataagccgaccaggtagctgtaccacggaaaaatcgtcaggatttcggtcgactcttccatattggtggagtgcaatgccagcaatgtattgaaattaggcgcgccgtaggcctgagcaaaagggaaataacaagccgccaccagcgaactgacaccgaccagaactttttgtacgcgaggcaatgttcgccatagcaaaagcaaaatagccgtaaacgcagcggtgtagagcaaactgaaggggtaacctaagccgaggttaattaatagcgactgtaaaaagtagaacgcagtccacgggctaaatacccggctacgggtaacaagcgattctttgagggttaaattcatatgccactatcgtaacaaacgccatgtgcttaccctggcgtcaagggtcaatacctgcaagagtgcgtgaagagtggaaaggggtccgcatccgcgagccgcaatatacgcagggctgcaagaagatagagcgagccgccgttcaggtcaactactgacgaacaaatcttttgcgaaggggattgcaaatccgacaaaaagtggggtttttcagaccaaaacgcgttatgcctgcatgaaagcaggagtgaagcggcgtaccgcgacgccgctatttatcggaaggtttatcttgctgcggtttgttgttgaccatatcgcacaacatagagagcagcattaaccgtactttaaagggagaatgactaaacacgcgcatacacctcttgaactcattcataagacctcctgacttgctaatcccgtcgatccttgagggatgattgcattacatacagatatagcacaggctatattatatagctattgctaaaacgttaattttttgtaccttcgcaactctggtttacaatgtgcgcacgaaatgagaacgctatgtatgcgtcaccataatgaggaagcacaatgagtcgtcgcgcaggtacgccaacagcaaaaaaagtgacgcagttagtgaacgtggaagagcacgttgaagggttccgccaggtcagagaggcgcatcggcgcgagcttattgatgattacgttgagctgatttctgacttgatcagggaagtgggggaagctcgtcaggtggacatggctgctcgtctgggagtttcgcaaccgacggtggctaaaatgcttaagcggctggcaaccatggggctgattgaaatgatcccctggcgtggcgtgtttttaacggcagaaggagagaagctggcgcaggaaagccgcgagcgacatcagatagtcgaaaatttcttgttggtgttgggcgtcagtccggaaatcgcccgtcgcgacgcggaaggcatggagcaccatgttagtgaagagacgctcgacgcttttcgtttgtttacccagaaacacggtgccaaatgagcctgccttttttacgcacgctgcaaggcgatcgtttttttcagttattaattcttgttggtatcggattaagctttttcgtgccctttgcaccgaaatcctggcctgctgctatcgactggcacaccatcatcaccttaagcggcctgatgctgctgaccaaaggtgtggagttaagcggttattttgatgtgctggggcgcaaaatggtgcgccgctttgctacggagcgtcggctggcgatgtttatggtgctggcggcggcgctgctttctacctttctgaccaacgatgtcgcgctgtttattgttgttccgctgactatcacgctaaaaagactgtgtgagatcccggttaatcggctgattatttttgaggcgctggcagtcaacgctggttcgctactgacgccaattggcaacccgcaaaatattcttatctggggacgttctggtctttcgtttgccggatttattgcccaaatggcaccgctggctggcgcaatgatgctgacgctcctgctcctgtgctggtgttgtttccctggaaaggcgctgcaataccatacgggggtgcaaacaccggagtggaaaccgcggctggtgtggagttgtctggggctgtatatcgtctttctgacggcgctggagttcaaacaagagctgtggggactggtgattgtggcggcaggctttgcgctgctggcacgtcgcgtggtgctcagtgtggactggacgctgctgctggtgtttatggcgatgtttatcgacgtccatttactgacccagcttccagcgttgcaaggcgtgttgggtaacgtgagtcatctatctgaacccgggttatggttaacggcaatcggtttatcgcaggtgatcagtaacgtgccgagtaccatattgttgctgaactatgtgccgccgtctttattactggtatgggcggtaaacgtaggtggctttgggttattacccggatcgctggcaaatttgattgcgctacgtatggcgaacgatcgccgcatctggtggcgtttccatctctattcaataccgatgctgttgtgggcggcgttggtgggatatgttttgttagttatactcccggccaactagggtctggcaaataaaaaaggcggattatgagtccgccttttgctttaagttttgaagattaattcagacgaaccggcatcccggagcggtttttaatcgcttcatcaagaacaacctggtcaacatctggctgaccggtcactgtttgcacgctcttcgtcagggtaattggcacaatttcctgaccttcaaactgggcttcggtggtagacagcgggttatggacttcaatataacggctgccgtctggctcggtggtcgcttttaccggctcatcaataaactgtacgcgggtaccgaccggtactttctcgaacaggaatttgatgtcttcgttacgcagacgcacacaaccatgacttacacgcaggccgataccgaagttggcgttggtgccatggatagcgtacaggcgaccgatgtagagtgcatacagccccatcgggttatccggacctgccggaacgacagccggaagcggttcgcccgcagcgcggtactctgcgtgcattttggcggtcggcgtccaggtcgggcctgctttcttacgctcaactttggtggtccagttgataggcgtatctttgcctaactgaccaatgccgatcggcagcacgataacggtgttggtccctttcggatagtaatacagacgcatctctgcactgttaatgacgatgccttcatgaacggtatccggcaggatcagctgctgcggaatgttcagtacagtaccgcctttcggcaggaaggtatccacacccgggttcgcttccatcatattggaaagccccatctggtactccgcggcaaaatactccagcggctgagtgttaccttcaggaatggtgatcacctgattctgaccaaccaggcgactcccgtcggttggcagaggataagttaccgcagaggcggtactgcaaaagccgacaacagcgaaggccgctgcgaataatgttttcaatttcatattcatgttaagcgagattttgtgcctggcaggccattgggttgagaatattagagtattggaagcgcattataagttcattccagctcacagtgaaatcagatgtgtacgaaatcacattttttgcctttggcttgagtgtagaccttaagcgaggagcaggatcttctttcagacttatggcataatgcgcggtttgtcatatctcttttcaggatacgcctgtgttagtttccagtaacgtcaccatgcagttcggcagtaagccgttgtttgaaaacatttccgtcaaatttggcggcggcaaccgttacggcctgattggcgcgaacggtagtggtaaatccacctttatgaagatcctcggcggcgaccttgagccgacgctgggtaacgtttccctcgatcccaacgagcgcattggtaaactgcgtcaggatcagtttgcctttgaagagttcactgtgctggatacggtgatcatggggcataaagagttgtgggaagtgaagcaggagcgcgaccgcatctatgctttgccggaaatgagtgaagaagacggctataaagtggccgatctggaagttaaatacggcgaaatggacggttactctgcggaagctcgcgccggtgaactgttgcttggcgtgggaattccagtggaacagcactacggcccgatgagtgaagttgctcctggctggaagctgcgtgtgcttctggcgcaggcgctgtttgctgatccggatattctcctgctcgacgaaccgaccaacaacctcgacatcgacaccattcgctggctggaacaggtgctgaacgagcgtgacagcaccatgatcatcatctcgcacgaccgtcacttccttaacatggtctgtacccacatggcggatctggattacggcgagctgcgcgtttatccgggtaactacgatgagtacatgacggcggcgacccaggcgcgtgaacgtctgctggccgataacgccaagaagaaagcgcagattgctgagttgcaatctttcgttagccgctttagcgccaacgcctcgaaatctcgccaggcaacttcgcgcgcgcgccagattgataaaatcaaactggaagaggtgaaagcctccagccgtcagaacccgttcatccgttttgaacaggataagaaactgttccgtaacgcgctggaagtggaaggtctgaccaaagggtttgataacggtccgctgtttaaaaatctcaacctgctgctggaagtgggtgaaaaactggcggtactgggtaccaacggcgtcggtaaatcaacgctgctgaaaacgctggtgggcgatctgcaaccggacagcggcaccgtaaaatggtctgagaacgcgcgcattggttactatgctcaggaccacgaatatgagtttgaaaatgatctgaccgtgttcgaatggatgagccagtggaagcaggaaggcgatgacgagcaggcggtacgcagcattctcggtcgtttgctgttcagccaggacgacatcaaaaagccagctaaagtgctttccggtggggaaaaagggcggatgctgtttggtaagttaatgatgcagaagccgaacattctgatcatggacgaaccgaccaaccacctggatatggaatccattgagtcgctgaacatggcactggaactgtatcagggcacgctgatctttgtttctcacgaccgtgagtttgtaagctccctggcgacccgtattctggaaatcaccccggaacgcgtgatcgactttagcggtaattatgaagattacctgcgtagtaaagggatcgagtaagttattatcagtagccctgatatggtcagggctactgaaactgatgacaaatgtaaaattgcctgatgcgctacgcttatcaggccttgtattatccctccagtgcagagaaaatcggccagttttctctgcctgcagtccgcatgccgtatcgggccttgggttctaacctgttgcgtagatttatgcagcggactgcctttctcccaaagtgataaaccggacagtatcatggaccggttttcccggtaatccgtatttgcaaggttggtttcactatggaacatgaacttcattatatcggtatcgacaccgctaaagagaaactggatgtcgatgtgttgcgtcctgatggtcgtcatcgcaccaaaaaattcgctaacaccactaaagggcacgatgagctggtgagctggctgaaaggtcacaagattgaccatgcgcatatctgcatcgaagcgaccggcacctatatggaacctgtcgctgagtgcctttacgatgctggctacatagtgtcagtcattaatcctgcgctgggtaaagctttcgctcagagtgaaggactgcgtaacaagactgataccgtggatgcgcgcatgctggcagagttctgtcgtcagaagcgccctgcagcctgggaagcgcctcacccgcttgaacgcgcgttgcgtgccctggtagtccgccaccaggcgctgacagatatgcacacgcaggaactgaatcgcactgaaacggcgcgggaagtccagagaccgagcattgatgctcaccttctgtggcttgaagcagagctgaagcgtcttgagaagcagataaaagacctgacagacgatgatccggatatgaaacaccgcaggaaactgctggaaagcatcccgggtatcggagagaaaacatctgcggtattgctggcttatatcggtctgaaggaccgcttcgcccatgccagacagttcgccgcttttgcgggtctgacaccacggcgttatgaatcaggtagcagtgtgagaggggcgagccgaatgagtaaggccggacatgtgtcgcttcgcagggcgttgtatatgcccgcaatggtagccaccagtaagactgagtggggacgggcgttccgcgaccgtctggcggctaatggcaagaaaggaaaggtgattctcggcgcgatgatgcgcaagctggcacaggtggcgtatggagtgctgaagtcaggcgtgccgttcgatgcgtcacggcataatccggtagcggcgtaaaaatcgcggaagggatgaaaaaaacagcgcctgacggcgctgtgtctggcatgcctgcaatccgggaaaccggaccaggaaaaaacttgcaggccataacagtatctacgcagtgcctgtaatatattgaatctgcaggactttgtaggccagataagacgttaacgccgcatcaggcattaagaaagcgcacttgtcagcaatctgagtaacgtcgaatcgattttcttaatcccacatcaattcacttccattaactctcaaacgtccatgcccaacgctcgcttaccgtgaatgttgaggtcggcaagcgtaaagcgtccttcccagtttgtttcatagtcctcgcgcgggaagtcgcccggcgatgcgcctttttccagtgcggccttcaccttgtgcgcgtaggcaagatttttctcgcacatcggtgccgcaggaatgtacatcacgttgccccagccctgttgattttcaacgggggcaacggaatggatgacgtcgcagtgccaccagacggagtctccggcctcgagttttggaatgctggttaacgcctcaattaacagtggatgccattgctctgataccggcaacactcttccgggcgctacgccgcacagttcatcctccggcacatcatcaagcagcggacgtaacagtacgtacgccatggcttcaggaatgggcacgacgtgcagcagtccctgaccaggtagcatatcagagagcgctgtccagccctggaatgtccgaaacacggaacatttggtggtgttgtccaccgtgtactcttcaacttccgtacgatgtgccgcatgccagggatcgtatttcgccagattgccattaaagacgttggcgaaaacgtgctgatacgctggaagcagccagcgttccagtgccccggagtcggtatgcgctccaagacctttggaggtcgttccgggcggacggcggcggatacggtcagggtagatgacgctcacatccgggttaaaccattgttttccatcactttcaaatgtccacagacgattgagaaacgactgcgcattcgccatttcttcactctggcgggcctgcatttgcgcctgcgaccagtagatggggtaaatctcgggacgtgaagcgctgagcgtcccgaagaaattatcgccggggcctttgtagacctcgtcaaagcggttgcggtccagatagtccagcatcgactgatcccagcctagcgcttgttcgcgggggaaatggccttttatcaccgcacaaccgcgacgtttaatctgttcgcgctgctctgcagtaacatgacctgctttgatatcggcatatgacagcaccggccagacggcatcgccctgtgctttgagtgcgttgatttcagccactcgcgtggcaatgtcatcgcttagctgattaaagatctgctggacgtcgccaagctgcgcccgcagcgcgtgcttcatctgacggatagctgctttgtgatcggcaggcaatgtgtcgctggtaaaagtagaagccataaccacctcgcattaactttcattcgaaactataatgatttgcatgtgacaatataagttataaataagttaatgcaagtttagtgatttgatgtgatgtacaggatgtaaaaagaagggaaaaccggagcgcatggctccggtagagaggtcagctgttaaaaggggatgtgttatccagcacagcctgaatcacattcagcgcgccttcatgattattatcatcggtagcgtaacgggcgatttgtttaatgttttccgcagcattgcccatcgcaaaggaataacgcgccattttcagcatctccgcatcgttaccgctgtcgccaatcgctaccacattttgcggtgacagatcccagcgtttcagtaaccgcgaaataccgtttgctttatgtagaccgggaataatcaggtcgataaagccaaaaccactggtgacgggtttcataatgccatcgagcgctacgtgcagtttgtcgatcactaacgggatttgttcatccggcaggttgagcgaaaacttgaacagtacgtcgtcaatctcctgataatcttttacaggtttcaggcgatggtagtgttttgccatcagtgcgacgaatgcttcgggggcgttttcgctgacatatgcactttgcagaccgcaggcgacaaaattgagttgcttatcttttagcaactcgccaataacaatccgcgattcatgtcgggtcagttcgccgtggaacagttgcttgccatgttcgtaaaccagtgcgccgttttccgcgacaaaagagatctcatcctttagctcaggaaagaatgaaataagctggtaatactgattaccgctggcgacaacgaactcaatgccgcgctttttcagttcctgatattgcgccataaaacgtggttggttgtacgttttgacgttgttaagaaaagtaccgtccatatctgtgacgataacttttacgctcataggtgtgctcccggctcgaaaatgaaaccgtaacagtgtaataacaatgtgacgtagagcacaaattatatttcgaatgaaagtaaggatgaaattgatgatgtgaatgatttagcccggcgacgacgccgccgggccgaggagattacagcatatgttcagtacgggcgatgatatcgtcctgagcgtctggagagagcgcggtgaagaaggcggaatagcccgcgacacgcactaccagatcgcgatactgatcgggatgttttttcgcctccagcagcgtttcgcgggaaacgatgttgtactgaatatgccagcctttatgcacctcgaagaaggtacggagcaggatcatcagtttctgcttgtcagattcgttctccagcgtcgccggattcagtttctggttgagcaacacgccgccgagaatcgctgctgtaggcagtttacccaccgatccaatgactgccgttgggccgagatggtcagtaccggaagccgggcttgcgccttctgccagcggggtatgcgctttacgtccgtccggcgttgccatcgtctgcgcgccaaacggtacgttagcggagatagacgacgtacccgcgtaatagttgccgccaaccggaccacgaccgtagcgcggattatggtactgtttcagttcgtcgatataggtctgataagcgcgagccagcagcgtatcgacagtatcatcgtcgttaccgtacttcggcgcaccgttaatcagccgctgacgcagttgctcatgagtcaggccgtcgaagtcatccgccagtgcggcagccagctgttgctgaccaatcgcgccctgttcaaacaccagtttcttcactgccgccaggctgttgccgaggttggcaatgccgacctgcaggccagaaacccagtcatatttcgcgccgccttgcttgatactttttgctcgctcaatacagtcatccaccagcgccgagcagagaatatcgtgcacgttctcttccagcatggtgtcgacgacatattcgatttcgattgatttgcgggtgtagtaacggatttgcgtatcccacgcgtccattacttcatcgaagttgttgaagttacctgccgacaacgctttttcttgtgccaggaacactttgccgctggtggcatcacgaccgccttccagcgcagccagcatcacgcgggcgaagttgataaagctcatgccggtacagcgatagccccatttgccaccgacggcggtttcgatacaaccaatcgctgcgtagtcgtaagcgtcctgcggttcaataccgagtttaataaattccgggatcacgatttcgtcgttgttgaaggccggcatcccgaagccgcaccggatcacctgtacgcaggcgtcgaggaaatcgttactcattcccgcatggtagcgcacgctgaggttaggctgcgtcgaacgcaggcgaccgcaggattcgaggatcgcgtaggagagcggattcaccgcatccatcggctgaccatcaatcaaattttgcccgccaatggtgacgttctgatacagcgggctacccgcagaggcttttgagtgtgagccggagcggatcttgttcacttccagcaatttcaaccagcagctatgcagcaattcgatggcgtgttcgcgttccagcatttggttcagttcaacatcacggcgataatacgggtagagatactggtccatacgaccaaacgacaccgagtgaccgttagattcaatctgcaaaatcaactggatgaagtagcacagttgcagcgcctgccagaacgtctgcggcggctggtgggcgataagatcgcagttttctgctatcgccagcagttcatcgcgacggctttcgcgggtttcggtcgcggccatttcacgcgccagggcagcgaaacgttcaatgtgttcactgactgccaccagcacgatatcaatcgctttcaggaactgctcgccgtgcaaatcttccagcaccgtcaggttgatgcgcgagcgacgttccgccactttctcgcgcagaccatcaagccctttttccagcagcagcgggaaattgaccgccaggtgcgcatcgccggaagtcatattgccctccgctttaatgattccggtcgccagcagacctttttgctcatcggtaaacatgccgtagcaacgatcctgtaccgtctgaccgcgccaccaagggcacacttcatgcagaacacgtttgttctcttcgctcaccgcaaaaccagcacccggacgatctgccagatcatcaatctctttttcgatccaggagacggtatattccgggaagatcggcgcggcgcgaacttcgcttgcctggttgccaatgatcaactcatcgtgcttgatccagatagtgcgattcgccaggtgatgcgccagtgccagcgcgcgacgtaccgggatcggcttatcgagatgttgttgatacatctcggtatagtgctgcgcgcgctcggtacagactggcggtttcacaatatgcaccagcgcatttttgtgcgctttaatgcggtcgctgagcgtgtccagtttcagtgtggtcatggttgttatcctcgtaaggtcgcggttaaccctttctggcaggcatactgctgggcaaaatcgagcagttctggcgcatcaagcggtttttccggggcgtcatagggcagattaagtaagtgatatttgttgatgcccagcgtgtggtagggcaggaaatgaatttcgccaacgtgcagctcgtcggcggcaaaatcggtaatggcttttacagaggtttcgtcggcattaaagccctgaatcagcggcacgcggataatgatttttttgcccgctgcggcgagttttttcaggttatccagcactctggcggcgttaccgtcggtccactgtttaaacggcgcgtcggcaacgtgttttaaatcggcaagaaacagatcgatatagggcagagaaggggcgatatatttccacggcacatgcagacaggtttctactgcagtatgaatgcctgcctcgtggctggcttgcagtagcgccgtcgccatctccggctgcataaagggttcaccacccgaaagcgttaagccgccgccgctgcgatcgtaaaacggtttatcgcgcaaaacggtcgccatgatctcctcaacgcttttcacttcaccacacacggttaacgcctgtgtcggacagcagtcggttaacgccgtcagatgctccggggttaacttttcccgatgaataagcaaaccattcagcgcgcgctcaatcacttccggcgcggccttagcgcacagctcgcagccttccagacacagtcgtgcgtcatacagcagatcctgcgtgcgggcgcggctttccgggttctgacaccagcggcagcccagcgaacagcctttaagaaatacgaccgtgcggataccggggccatcatgggtcgagtagcgctgaatattgaaaatcatagttgcctctctgtttcgttcaaacattaaaatactttcgaatgaaagttagattgatgtgcgtcaactgttcagagagttttcccgtgatagtctacattcagacaaaaagtacattttgaggatggttatggaactgtatctggatacttcagacgttgttgcggtgaaggcgctgtcacgtatttttccgctggcgggtgtgaccactaacccaagcattatcgccgcgggtaaaaaaccgctggatgttgtgcttccggaacttcatgaagcgatgggcggtcaggggcgtctgtttgcccaggtaatggctaccactgccgaagggatggttaatgacgcgcttaagctgcgttctattattgcggatatcgtggtgaaagttccggtgaccgccgaggggctggcagcgattaagatgttaaaagcggaagggattacgacgctgggaaccgcggtatatggcgcggcacaagggctgctgtcggcgctggcaggtgcggaatatgttgcgccttacgtcaaccgtattgatgctcagggcggtagcggcattcagactgtgaccgacttacaccagttattgaaaatgcatgcgccgcaggcgaaagtgctggcagcgagtttcaaaaccccgcgtcaggcgctggactgcttactggcaggatgtgaatcaattactctgccactggatgtggcacaacagatgattagctatccggctgtcgatgccgcggtggcgaagtttgagcaggactggctgggggcgtttggcagaacgtcgatttaaccggacgttctgcatcctcataaattgctgatgacgtggcggagtgccgcgtcttatcaggcctggaggtggcaattactgcccgcacacctcacaccccggattgcgcatcagtttcatttcgcgaaactgacaggtcatcgcatcgtacatgacgattttcccgctggccggtttgccataacctgccagcagtttgatcgcttccattgcctgcaacgaaccaattacgccgatcaacggtgccatcacgcctgcttctacgcaggttaacgcgttctcgccaaacaaacggctgaggcagcgatagcaaggctcgccgtcctgataagtgaagaccgtgatttgaccttccatacgaattgccgcgccggaaaccagcggcaccttcgcggcaaaacagcctgcgttcagttgattacgtaccgcaacgttatccgtacagtcgagcaccagatcgtgttcagcaatcaatgctgcaagttctgcgtcatccagcagtgcattgactggcgtaatcgcgatatgtgggttgatccgcgccagggcgtcacgggcggattccaccttcggttgcccgaccgtagcatcactgtgcagcgtctggcgttgcagattcgagagcgaaaccgtgtcgaagtcgagcagcgtcaggttgccgacaccggcgcttgccagatactgcgaggctgcgcagccgagtccaccgaggccgactaccagcacacgagaatcttttagtgcctcctgaccgtcaaaatcaaaaccgcgcagaatgatttgccggttgtagcgcagcatctcctgatcgctgagttccgccattaccggcctccgaacaacgcgttaaacggttctacttccacccattcgcccacgtccacattgccgcgatcgcgttccagcacgataaagcagttgccgaggctaaaggagctgaatatatgtgaaccctgatgtccggtggtcgtcacttccagttcgccatcggcgttgcgttgcagcacgccgcgctggaaatcaagacgtcctggcgtttttttcaggcgggacgctgtgcgtacgcgctggcgcgcgggcaggccgctggcggtgttaccgcttagttttgccagcaaaggctgtaccagttgatagaaggtcagcgtcgctgaaaccgggttgcccggcaggccgcagaaccagctattgctgagtttaccaaacgcgaacggtttgcccggtttaatcgccagtttccagaaagcaatttcgcccagttcttcgagaatggttttggtgtaatccgcctcaccaaccgaaacaccaccggaactgatcaccacatccgcctggctgtcggcttcaataaatgcggcgcgcagggcatgtggatcgtcggggataatccctaagttgattacctcgcatcccagctgttctaacatcaggtgtacggcgagacggttggtatcgtagatttggccgtcgcccagcggctggcctggcaactggagttcatcaccggtagaaaaaagcgctacacgcactttacgaatcaccggaacttcggcaatccccagtgaagcaattactggcagctctgcggtagtcaggcgagttcccgccgggaaaacaaccgcacccgcagagatatcttcaccgcgacggcgaatattttgcccgctacgcacttcaacagtaaaacgcacgccattgtccgtttgttcagtctgctcctgcatcaccaccgcttcgcagacttccggcaccggcgcaccggtcataatacgaatgcaggtgcccgcaggccattcaccatgatacggctgaccggcaaacgatttcccggcaacgggcagcggttgcccggaggcaatatcggctaaacgcaccgcgtagccgtccatagcggagttatcaaaccccgggacatccagtggcgaaacgacatcgctcgccagaatacgaccaaaacactgtaccagtggcagcgtttcctgggcggtcagtggggtgacgcgagaaagcatctcattaagcgcggtgtcgagcgacatcaatccggtggtaaattccatgaaaacactcctgcggaggcaaaatcgaatttgcctattatgtcagaaaaacgccacagactgtatgccacctcgggcgtagcgctgggtcctgcctttacatgccatatccatctttctatattcaaaaattgaatgagtaattcataaaaattctgatatttatagcaaaagtggcgagccacccttaatggacgaatactatgggcaaagcagtcattgcaattcatggtggcgcaggtgcaattagccgcgcgcagatgagtctgcaacaggaattacgctacattgaggcgttgtctgccattgttgaaaccgggcagaaaatgctggaagcgggcgaaagtgcgctggatgtggtgacggaagcggtgcgtctgctggaagagtgtccactgtttaacgccggaattggcgctgtctttacgcgtgatgaaacccatgaactggacgccagtgtgatggatggtaacaccctgaaagccggtgcggtggcgggcgttagtcatctgcgtaatccggttcttgccgcccggctggtgatggagcaaagcccgcatgtgatgatgattggcgaaggggcagaaaattttgcgtttgctcatggcatggagcgcgtctcaccggagattttctccacgcctttgcgttatgaacaactactggcagcgcgcgaggaaggggcaacagtcctcgaccatagcggtgcgccactggatgaaaaacagaaaatgggcaccgtgggggccgtggcgttggatttagacggcaatctggcggcagccacgtccacaggcggaatgaccaataaattacccggacgagttggcgatagtcccttagtgggtgccggatgctacgccaataacgccagtgtggcggtttcttgtaccggcacgggcgaagtcttcatccgcgcgctgacggcatatgacatcgccgcgttaatggattacggcggattaagtctcgcggaagcctgcgagcgggtagtaatggaaaaactccctgcgcttggcggtagcggtggcttaatcgctatcgaccatgaagggaatgtcgcgctaccgtttaacaccgaaggaatgtatcgcgcctggggctacgcaggcgatacgccaaccaccggtatctaccgtgaaaaaggggacaccgttgccacacagtgatgaacttgatgccggtgatgtgctggcggttgaaaatctgaaaattgcctttatgcaggaccagcagaaaatagctgcggtccgcaatctctcttttagccttcaacgcggtgagacgctggccattgttggcgaatccggctccggtaagtcagtgactgcgctggcattgatgcgtctgttggaacaggcgggcggtttagtacagtgcgataaaatgctgttgcggcggcgcagtcgtgaagtgattgaacttagcgagcagagcgctgcacaaatgcgccatgtgcgcggtgcggatatggcgatgatatttcaggagccgatgacatcgctgaacccggtatttactgtgggtgaacagattgccgaatcaattcgtctgcatcagaacgccagtcgtgaagaagcgatggtcgaggcgaagcggatgctggatcaggtacgcattccggaggcacaaaccattctttcacgttatccgcatcaactctctggcgggatgcgccagcgagtgatgattgcgatggcgctgtcatgccgcccggcggtgctgattgccgatgagccaaccaccgcgctggatgtcactattcaggcgcagatcctgcaattaatcaaagtattgcaaaaagagatgtcgatgggcgttatctttatcactcacgatatgggcgtggtggcagagattgccgatcgggtactggtgatgtatcagggcgaggcggtggaaacgggtaccgtcgaacagatttttcatgcaccgcaacatccttacacccgtgcgctgttagctgctgttccgcaacttggtgcgatgaaagggttagattatccccgacgtttcccattgatatcgcttgaacatccagcgaaacaggaaccccccatcgagcagaaaacggtggtggatggcgaacctgttttacgggtgcgtaatcttgtcacccgtttccctttgcgcagcggtttgttgaatcgcgtaacgcgggaagtgcatgccgttgagaaagtcagttttgatctctggcctggcgaaacgctatcgctggtgggcgagtctggcagcggtaaatccactaccgggcgggcgttgctgcgcctggtcgaatcgcagggcggcgaaattatctttaacggtcagcgaatcgataccttgtcacccggcaaacttcaggcattacgccgggatattcagtttatttttcaggacccttacgcttcgctggacccacgtcagaccatcggtgattcgattatcgaaccgctgcgcgtacacggtttattgccaggtaaagacgcggctgcacgcgttgcgtggttgctggagcgcgtgggcctgttacctgaacatgcctggcgttacccgcatgagttttccggcggtcagcgccagcgcatctgcattgctcgcgcgttggcattgaatccaaaagtgatcattgccgacgaagccgtttcggcgctggatgtttctattcgcgggcagattatcaacttgttgctcgatctccagcgtgatttcggcattgcgtatctgtttatctcccacgatatggccgtggtagagcggattagtcatcgtgtggcggtgatgtatctcgggcaaattgttgaaattggcccacggcgcgcggtcttcgaaaacccgcagcatccttatacgcgtaaattactggcggcagttccggtcgctgaaccgtcccgacaacgaccgcagcgtgtactgctgtcggacgatcttcccagcaatattcatctgcgtggcgaagaggtggcaggcgtctcgttgcaatgcgtcgggccggggcattacgtcgcacaaccacaatcagaatacgcattcatgcgtagataacattcaggcggagaataaaatggcaagagctgtacaccgtagtgggttagtggcgctgggcattgcgacagcgttgatggcatcttgtgcattcgctgccaaagatgtggtggtggcggtaggatcgaacttcaccacgctcgatccgtatgacgcaaatgacacgttatctcaggccgtagcgaaatcgttttaccaggggctgtttggtctggataaagagatgaaactgaaaaacgtgctggcggagagttataccgtttccgatgacggccttacatacaccgtgaaattgcgggaaggcattaaattccaggatggcaccgatttcaacgcagcggcagtaaaagcgaatctggaccgggccagcgatccggcgaatcatcttaaacgctataacctgtataagaatattgccaaaacggaggcgatcgatccgacaacggtaaagattactctcaaacagccgttttcagcgtttattaatattcttgcccatccggcgaccgcgatgatttcaccggcagcgctggaaaaatatggcaaggagattggttttcatccggtgggaaccggaccgtatgaactggatacctggaatcagaccgattttgtgaaggtgaaaaaattcgcgggttactggcagccaggattgcccaaactggacagcataacctggcgtccggtggcggataacaacacccgcgcggcaatgctgcaaaccggtgaagcgcagtttgctttccccattccttacgagcaggccgcactgctggagaaaaacaaaaatatcgagttgatggccagtccgtcaattatgcagcgttatatcagtatgaacgtgacgcaaaaaccgttcgataacccgaaggtccgtgaggcgctgaattacgccattaaccgcccggcgctggtgaaagtagccttcgcgggctatgcaacgccagctactggtgtggtaccgccgagtatcgcctacgcgcaaagttataaaccgtggccttacgatccagtgaaagcgcgcgaattactgaaagaggcgggatatcccaacggtttcagtaccacgctgtggtcgtcacataaccacagcaccgcgcagaaagtgctgcaatttacccagcagcagttagcgcaggtcgggattaaagcccaggtgactgcgatggatgccggacagcgggcggcagaagttgaaggtaaagggcaaaaagagagcggcgtgcggatgttctacactggctggtcggcttcaaccggcgaagctgactgggcactatcgccgctgtttgcatcgcaaaactggccaccgacgctgtttaataccgcgttttacagcaataaacaggtggatgacttcctggatcaggcactgaaaacgaatgatccggtggaaaagacccgcttatataaggcggcgcaggatatcatctggcaagaatcgccgtggatcccgctggtggtagaaaaactggtgtcggcacacagtaaaaacctgaccggtttttggatcatgccagacaccggcttcagctttgaagacgcggatttgcaataagcaacgcagggagtggaatgcttaattacgttatcaaacgcttactggggttgattccaacgctgtttatcgtctcggtgctggtgtttttatttgtgcatatgctgcccggcgatccggcgcgattgattgccgggcccgaagctgatgcgcaggttatagaactggtgcgtcagcagctggggttggatcagccgctgtatcaccagttctggcactatatcagcaatgctgtgcagggggattttggcctgtcgatggtgtcgcgtcgtccggttgccgatgagattgccagccgctttatgccaacgctgtggctgaccataaccagtatggtctgggcggtgatatttggtatggcggcgggaattatcgccgccgtctggcgtaatcgttggccggatcgattgagtatgaccattgcggtgtcggggatctcgtttccggcatttgctctggggatgcttttaattcaggtattctccgttgaactgggctggctgcctaccgtgggagcagacagttggcagcactacattttaccctccctgacgctcggcgcggcagtggccgccgtgatggcgcgctttacacgcgcgtcgtttgtcgacgttttaagcgaagattatatgcgtaccgcgagggcgaaaggggtgagcgaaacctgggttgtcctcaaacacgggctacgcaacgcgatgatcccggtagtgaccatgatgggcttacagtttggctttttgctcggtggttctatcgtggtggagaaagttttcaactggcccggacttggacgcttactcgttgactccgtagaaatgcgcgattacccggtgattcaggcggaaattctgcttttctcgctggaatttattcttatcaacttagtggtggatgtgctttacgccgccattaacccggctatcaggtacaagtaaggatgcgactatttaactggcgacgtcaggcggtgttaaacgccatgccactggtcaaacctgaccaggtacgtacaccgtggcatgaattctggcgacgatttcgccgtcagcatatggcgatgaccgccgcattgttcgttattttattgattgtggtggctatttttgcacgctggatcgctccctatgacgccgaaaattattttgattatgacaatctgaataacggaccttctttgcagcactggtttggcgtcgattcactggggcgtgacattttcagccgtgtcctggttggtgcgcaaatctcgctggcggcgggcgtgtttgccgtgtttatcggtgcggcgatcgggacgttgctgggcttgctggctggatattatgaaggctggtgggatcggctgatcatgcgcatttgcgatgtgctgtttgccttcccgggtattttactggcgatcgctgttgttgcggtgttgggaagcggcattgctaacgtgattatcgcagtcgccattttttccatccccgcgtttgcccgactggtgcgcggcaacacgctggtgttgaaacagcaaacctttattgagtcagcacgcagtattggtgccagcgatatgaccattttattgcgtcatatcttgcctgggaccgtctcgtctatcgtggtgtttttcaccatgcgcattggcacctcgattatctctgccgccagcctgtcatttctcggcctcggtgctcaaccgccgacaccagagtggggagcaatgctcaatgaggcacgagcggatatggttatcgcgccgtatgtcgctatttttccggccctggctatttttctgaccgtactggcgttcaatttgttgggcgatggtttacgcgatgcgctggatccgaaaattaaaggatagttacgtttgaatattgcttgaaagggtaatcacctcacaggaaattattgccctaagcaagtgttgtaactttctgctgattttgtagaatcgggtaatttggttaaaaagccgcagcaagggactatttttgcagcggcacagcgttcagacagttattttgttaaatgtattaacatgctgagtttatacgaaaagataaagataaggctgataattttatttttattggcagcactgtcatttattggtctttttttcatcattaactatcaactggtatcggaacgcgcggtaaaacgtgccgatagccgctttgaacttattcagaaaaacgttggctatttctttaaagatattgaacgttcggccctgacattaaaggactcactgtatttattaaaaaatacagaggagattcaacgcgccgtgattctgaaaatggaaatgatgccatttttagactcggtgggactggtacttgatgataataaatattatctcttttcacggagggcgaatgataaaatcgttgtttatcatcaggaacaagtaaatggaccgcttgtcgacgagtcagggcgggttatttttgccgattttaacccatcgaaacgaccgtggtcggtggcttcagatgactctaacaacagctggaatccggcatacaattgctttgatcgtccgggtaaaaaatgtatctcttttacgctacgtatcaacggcaaagatcacgatttgttagcggtagataaaattcatgtcgatttaaactggcggtatctgaacgagtatcttgatcaaatcagcgctaatgatgaagttctatttttgaaacaaggtcatgagatcattgccaagaatcaactcgctcgtgaaaaactgattatttataatagcgaaggtaattataatattattgattctgtcgatacggagtatattgcaaagacatcagcagtgccaaataatgcattgttcgaaatctatttttattatcctggcggtaatttattgaacgcctcagataaacttttttatctgccgtttgcgttcattattatcgtattgctggtggtttatttaatgaccactcgtgtgttccgtcggcaattttctgaaatgacagagctggttaatacgctggcatttttgcccgactcaacggatcaaatcgaggctctgaaaattcgcgaaggcgatgcgaaagagattatcagcattaaaaattcgatcgcggaaatgaaagatgccgaaattgaacggtcaaataaattgctctcactgatctcttacgatcaggaaagcggttttattaaaaatatggcgattattgagtccaacaataatcagtatctggctgtggggatcatcaaactgtgtggtctggaagccgtggaagcggtgtttggtgttgatgaacgcaataaaatcgtcaggaaattgtgtcagcgaattgccgaaaaatatgcgcaatgctgcgatatcgtgacattcaatgccgatctctatttacttctgtgccgggaaaatgtacagacatttatccgtaaaatagcgatggtaaacgattttgacagcagctttggctaccgtaatctgcgcatccataagtctgccatttgtgaacctttgcagggggaaaacgcctggagttacgcagaaaaactgaaactggcgatttccagtatccgtgaccatatgttctcagagtttattttctgtgatgacgcgaaactcaacgaaatagaagagaatatctggattgcgcgtaatattcgccatgcaatggaaattggcgaactattcctggtctatcaaccgatcgttgatattaacacccgcgccattctgggcgcggaggcgttgtgccgttgggtgtctgcggagcgggggatcatttcaccgctgaagttcattaccattgctgaagatatcgggtttatcaatgagctgggttatcagattattaaaacggcaatgggtgaattcagacattttagtcagcgtgcgtcgctgaaggatgatttcttactgcatattaatatttcgccatggcagttaaacgaaccgcactttcatgagcgttttaccaccatcatgaaagaaaatggcctgaaggcgaacagcctctgtgttgagatcactgaaaccgtgatcgagcgaattaatgaacatttttatctcaatattgaacaactgcgtaaacaaggggtacggatatcgattgatgactttggcaccggtttgtcaaacctgaaacgtttttatgaaattaatccagatagcataaaggtggactcgcaatttaccggcgatattttcggtactgcgggaaaaattgtgcgcattattttcgacctggcacgctataaccggatcccggtgattgcggaaggcgtagagagcgaagacgttgcgcgcgaattaatcaaattaggatgtgttcaggctcaggggtatctgtaccagaaacccatgccattctccgcctgggataaaagtggaaaattagtaaaagagtagtttacgtatgtccagaatcaataagttcgtacttacagtcagtctgctgatttttatcatgatttcagcagttgcctgcgggatctacactcaaatggtaaaggaacgggtgtatggcctgaaacagtccgttattgatactgcttttgcggtggcaaatattgctgaatatcggcgtagcgtggcaattgatcttatcaacacgctaaatcccacggaggaacagctgttggttggcttacgcacagcttacgctgactcggtttcaccctcttacttgtacgatgtcggtccttatctgatttccagtgacgaatgtattcaggtaaaggagttcgagaaaaattattgtgcagatattatgcaggttgtgaagtatcgacatgtcaaaaatacagggtttatctcttttgacggtaaaaccttcgtctattacctctatccggtaactcacaatcgtagtctgatatttttgcttggtctggagcgtttttctttactgtcaaaatctctggcgatggatagcgagaacctgatgttctctctgtttaagaacggtaaaccggtgaccggtgatgaatttaatgctaaaaacaccattttcaccgtttcggaagcgatggagcactttgcctatttgccgaccggattgtacgtatttgcgtataaaaaagatgtttatttgcgggtttgtacattgatcattttctttgccgcattggtggcagtgatatcgggtgccagttgcctctatctggtacgcagagtgattaatcgtggtattgtggagaaagaagccattattaataaccattttgaacgcgtactggatggcgggcttttcttttcggctgccgatgtcaaaaaactctacagtatgtataactcggcgttcctggacgacctgaccaaagcaatgggcagaaaatcctttgacgaagatttaaaagcgctgccggaaaaaggcggttatttgtgcctgtttgacgtcgataaattcaaaaatattaacgacaccttcggtcatttgctgggcgatgaagtgttgatgaaagtggtgaaaatccttaaatcacagatcccggtagataaaggtaaagtctaccgcttcggcggtgacgaatttgcggtgatttatactggcggcacgctggaagagttgctatcgatactaaaagaaatcgttcatttccaggtgggaagcattaatttaagcaccagtatcggtgtagcgcattcaaatgaatgtactaccgtcgaacgcttgaaaatgctggcggatgagcgactgtataagagtaagaaaaacggcagggctcagattagctggcagtagaattagaatagtgttagtacccctgaatcaaggggtactaatgaatgaggtaaatcatttgcaaacattttactttgcaaaaacttccggcccttttattgccaatgtattcaaaatacgtagtgccgggccgctcggttttatttcattacgttcccatttcgagacactttcttttgacattcccattgtatgtgccagcacggattgtgacatgccgtatcgggtgcggatggctttgatctcttcacccgtcattgatttgactttggctatacgggcgctgacttcacgggctttgaccatgacggcaatggcatcaacctcactatcagacatcaggcccaatgcattcagttcctttgcatcttccagcatcatttgtaatttatcgctcatttttcacctcaatcaagaagccagtttcgatcaaatcctctatttgcttattgctaaaggccagaaatgcatttgccatttttttgtaggctgccagttcatcatcttcgatttctttggttcctttactgcttagaccactcttggaccaaccatcataaaaaaacacatgatttgctgatttaaaaaagataattgttctggctccaccactctttccttgttggaggggtaaccgttttttgatgacaccgctacctaaatcagcctcccatatgccttgcatcacttcttcagcggcagccatgagaactttatcgtgaataccaagttttttcgtgctttggctgaatcgccttgccttatacacacccatacatccatccttgtggtaatgtttactatagtaaccattacgcttatttcaagtaattgcgatcaaaactttaatttggtgtgaaaaagtgagagttgcctcgagtacgattcatttttctcgatttatgcgtcaggggattttgtgcgtaagggtaggacatcgggaagggtagtagaggcagatcgaagaacaatatccttgttagatctgcctttagattaattaaacccggctaccccacaaatcgtactcatcggcgtgctcgactttcacacgcaggatatcacccggcttaacgttggtttcaccattgagataaaccgcgccgtcgatttccggtgcatctgccatgctgcgaccaatcgcgccttcttcgtccacttcgtcgataatcaccagaatttcacggcccactttctcttgcaggcgctcggcggaaatctgctgctgcagctgcatgaaacggttccagcgttcttctttaacttcttccggaacctggtcaggcagggcattggcgtctgcaccttcaaccgggctgtatttaaagcagccaacgcgatccagacgcgcttctttcaggaagtcgagtagcatctggaaatcttcttctgtctcgccagggaagccgacaataaaggttgagcgtagggtcagttccgggcagatttcgcgccactgtttgatgcgcgccagttggcgatctacagaacccggacgcttcatcagtttgagaatgcgcgggctggcgtgctgcaacggaatgtccagatacggcaggattttgccttctgccatcagtgggatgacgtcgtccacatgcggataagggtaaacgtagtgcagacgtgtccagatccccagtttcgataactgttcgcacaggctgaccatgctggtttttaccggctcgccgttgtggaagccagtacgatgtttaacatcaacgccataggcggaagtatcctgcgagatcaccagaatctctttaacgcccgcatctaccagacgtttcgcttcacttaacacttcgccaatcggacggctcaccaggtcgccgcgcatagacggaataatgcagaaggtgcagcggtgattacagccttccgaaattttcagataggcataatgacgcggcgtcagtttcacaccttgttctggcaccaggctcaggaatgggttgtgtttcggttttggcacgtagtgatgaacgtgctccagaacctgctcatagctatgaggcccggtgatttccagcactttcgggtggacttcgcggatctgatcttcttttgcccccagacaaccggtcacaattaccttgccgttttcattcaacgcttcaccaatggcttccagtgattcttgtaccgcgctgtcaataaagccgcaggtgttgacgatcaccatgtccgcatcgtcatagctcggtaccacgtcataaccttcagtgcggagttcggtgagaatacgctctgaatcgacaaggtttttcggacagccaagggaaacaaagccgattttcggctggggagttactttgctcatagcttaaaaaatattcagttacaggaaaggtcagggcagggattctacagagttctggataaaatttgtatcgcaatctcattcgctggcggaggcgaaggaaatgtaaattttgttaattcggcgtgaagaattgatcctggacagcattttgctcaaaaaatagccatacaatttaattgcaacaaggctggaaagaggaggatcgaagtatgttcgttgacagacagcgaatcgatctgctgaaccggttgatcgacgcacgcgttgacctcgctgcatacgtgcaactgaggaaggcaaaaggatacatgtccgtcagcgaaagcaatcatctacgagataacttttttaaactgaatcgcgaactgcacgataaatcgctgcggttgaatcttcatctggatcaggaagagtggagtgctcttcatcatgctgaagaagcattagcgacagccgcagtatgtttgatgagtgggcaccatgattgcccgactgttattaccgtcaacgccgataagcttgaaaattgtctgatgagcttaacgctgagtatccagagcctgcagaagcacgccatgcttgagaaggcctgaaaactaagggggagaaagcgtctcccccttcatgtttaagtttttgtaaaaatgaatttgttatctcctccactgactacgctttaagccagagtcaatccggaggcgttatgcatcgacaatcctttttccttgtgccccttatttgtctttcttccgctctctgggcggctcctgcaacggtaaatgtcgaagtactgcaagacaaactcgaccatccctgggcactggcctttttacccgataatcacggtatgttaatcactctgcgcggcggcgagttgcgtcactggcaagcaggaaaaggattatctgcgccgctttccggagttccggacgtttgggcgcacgggcagggcggcctgctggacgtggttttagcgcctgattttgctcagtctcgccgcatctggttaagttattccgaagttggcgatgatggcaaagccggaactgctgtgggttatggccgcttaagtgatgatctctcaaaagtgaccgacttccgcaccgtctttcgccagatgccaaaactgtctaccggcaaccattttggcgggcggctggtattcgacggtaaaggttatctttttattgctctgggcgaaaacaatcagcgcccgacggcgcaggatctggataaattacagggcaaactggtgcgtctgaccgaccagggcgaaatcccggatgataatccttttataaaggaatccggtgcgcgcgccgagatctggtcttatggcattcgtaatccgcaaggaatggcgatgaatccgtggagtaatgcactgtggctgaatgaacatggcccgcgcggtggtgatgaaattaatatcccgcaaaaaggcaaaaactacggctggccgctggcaacctggggaatcaactattcaggctttaagataccggaagcgaaaggggagatcgtcgccgggaccgagcaacctgttttttactggaaagattcgcccgctgtgagcggcatggccttctataacagcgataaattcccccagtagcagcaaaaattatttattggcgcgctgaaagataaagatgtcattgtgatgagcgtcaacggcgacaaagtgacagaagatggccgtattttaacggacagagggcagcgaattcgtgatgttcgcactggacccgacggttatttatacgttctcaccgacgagtccagtggggaattacttaaagttagcccacgcaattagctaacgggaatcatcaccactttgcgcactgcggggcgttcagtgagttgctgataccagcgttgcagatttggacgcggtgtccaggtcaggccaacgttaaacaaattgtagatgaacggtgcgatagcgatatcgcccacaccaaactcgtcgccagagaaccattttacttttgccagttccgcatcgagcagggcaaacagggcgtcgcactctttgcaactggcatcaatggcggcctgatcgcgctcttccagtggtgttctgactaatcccatcaggatcccgcgatgagcattactgagcgtctggtttgcccagtccatccatttttccgcttccgcacgacgtgccggtgagtcgatccacaggcgtttttgcccgtactgtgccgccagatagcggacaatggcgtttgattcccaaagaatgagatcactttcgtcgtcacgcaacaacggcaccagcccgttagggttcatcgccagaaaatcagcatcgtgatttatcccaaactcacggcccgcgagaatttgctcataaggtagttccagttcttcgagcgtcagcaatactttttttacgttagttgaattattccgaccccacagcgtaatcatactcaccccttttccgacaggcagccacaggctgaacaggactccgatggtgaagtaaagttaacttttaagcaacagctggcaaaaaaatgacaccagaagcagcgaagcggcaggatattgcataaactttaaaaactttaccaacttacggtttctttaagtttgtgtgtgcgttattaatcaccgaacttatcatacggcgatataacgtattttttttgaatggatactcgggtggcatttatgacgcaatactcctctctccttcgtggtcttgcagcgggttctgcatttttattcctttttgccccaacggcattcgcggcggaacaaaccgttgaagcgccgagcgtggatgcgcgtgcatggattttaatggattacgccagcggtaaagtgctagcagaaggcaacgcggatgagaaactggatcccgcgagcctgactaaaatcatgaccagctatgtggttgggcaggcgcttaaggccgataagattaaactcaccgatatggtgacggtcggtaaagatgcctgggcgacgggaaatccggcactgcgtggttcatcggtaatgttcctcaaaccgggcgatcaggtttcggtggcagacttgaacaaaggtgtgattatccagtccggtaatgacgcctgtattgcgctggccgattacgttgccgggagccaggagtcatttattggtttgatgaatggttatgccaaaaaactgggtctgaccaacactaccttccagacggtgcacggtctggatgcgccggggcagttcagtaccgcgcgcgatatggcattgctgggcaaagcattgatccacgatgtgccggaagagtacgccattcataaagagaaagagttcaccttcaacaaaattcgtcagcctaaccgtaaccgtctgctgtggagcagcaatctgaatgttgatggcatgaagacaggaaccacggcaggcgcgggatataatctggttgcttcggctacccagggcgatatgcgtttaatctccgtagtgctgggggcgaaaaccgaccgtatccgttttaatgagtctgagaaattattgacctggggtttccgcttctttgaaactgtgacgccaattaaacctgatgccacctttgtgactcagcgcgtctggtttggtgataagagcgaagtgaatctcggggcaggcgaagcgggctccgtgaccataccgcgtgggcagctgaaaaacctgaaagcgagttatacgttaacggaaccgcagcttaccgcaccgctgaaaaaaggtcaggttgtcgggaccattgatttccagcttaacggtaaatccattgagcagcgtccgctgatcgtgatggaaaatgtggaagagggcggattctttggtcgggtgtgggatttcgtgatgatgaaattccatcagtggttcggcagctggttctcttaatcttctgataaccggatggcgcgaaacgtcatccggttatacgtcattaatacatcaacttaatgcgctgcgtctgcgcgtacttcacatactcatcttccgggcaacaatcgctcaccacaatatcaaagcgtttcaggtcacccatgcgcgccggacgcaccttgccaaatttactgtggtcgacaaccagcacatgcttttgcgccatcgacatggcccagtgttttaccggcaactcttcaagattaaaacaggtagcgcctttactgacatgcacgcccgccgcagaataaaaagcgatatccgggcaaaaattattcagcgtttgctgaaaatcgatgggtttgaaaatggcgttgctggcgtgaaattcaccaccgcaaagaaacgcgcggcaatggggtttctctttcagcgccagaaaggtatttagcgaataacaaacggcggtaaaagggatttcattatcaatcgcttcaataatccacggcgtggtggtgccacagtcaaaaaagagggtctgatcgggttctaccagcgtcgcagccagttttgccgcccggcgtttttcttccaccaggcgggatttttgatcgcttaacaggtaatggctggcactgcgcggttccagaacaatatagccgccgagcaaaacgacgggcgcactgtggttgttcagatcgcgacgaatcgtcatctccgaaaccccaagcagggcggcggcgtctttaagatgtaacttatcgctgcgttttaattcttgcagcagctgcccgatacgctcttcgcgacgtgtttccataatccctctgaatagttattgaagcgagccgctcaatactacactttttagcagagatcagtcacgcacccagcctttgcggatcggtaatgcaaaacagacgcgataccacgattgcagacgttgatagagtttatgccccatcgcttgccagataatctgggcactaaggcagccaatcatacctgccagcaatccaccgagcatatccagcggccagtggacgccaagataaacgcgcgaccaggcaatgacgacggccagcaccattaaaagtgagccggaccacaggcgatgccagcataaaaatgccagtgcaaaggtgaaaatcaccgtaccgtgatcgcttgggaatgagtcatccgccgcatgatgcaggaagttatagccgatattttcgacaaagggtcggtcgtgcggaaaaagatgtcccatcgtccaggacacaaacaggctgaccgccagcgcgatagcgatttttatcaccagttgccgttgtgctgtaagcccccacaaccaaagtaccacggccagcaacggcaccacggtaatcaaatctttagcaataaaaatcgccaacgagatcatccacggagccgagtctggcgtcgcgttaataagagagaatagagagagattcaaattttccagcataacttcccgacgcaaagtgattaaaagggagccaatacaggcaagtcgttgagaataaagtgcaggttaaactgggtaaagcggcatcgtcttatttccctcaagcggcctgtttacggtgggtgattgtaacgggcataggttaaataaaacttaaagaaagcgtagctatactcgcaataatgtaagaatgtgcttaaccgtggtttcagctacaaaattcgctttctcgttagctgcgcttttattaaactctgcgcgattattattggcgaagaaattgcatgcaaaataaattagcttccggtgccaggcttggacgtcaggcgttacttttccctctctgtctggtgctttacgaattttcaacctatatcggcaacgatatgattcaacccggtatgttggccgtggtggaacaatatcaggcgggcattgattgggttcctacttcgatgaccgcgtatctggcgggcgggatgtttttacaatggctgctggggccgctgtcggatcgtattggtcgccgtccggtgatgctggcgggagtggtgtggtttatcgtcacctgtctggcaatattgctggcgcaaaacattgaacaattcaccctgttgcgcttcttgcagggcataagcctctgtttcattggcgctgtgggatacgccgcaattcaggaatccttcgaagaggcggtttgtatcaagatcaccgcgctgatggcgaacgtggcgctgattgctccgctacttggtccgctggtgggcgcggcgtggatccatgtgctgccctgggaggggatgtttgttttgtttgccgcattggcagcgatctcctttttcggtctgcaacgagccatgcctgaaaccgccacgcgtataggcgagaaactgtcactgaaagaactcggtcgtgactataagctggtgctgaagaacggccgctttgtggcgggggcgctggcgctgggattcgttagcctgccattgctggcgtggatcgcccagtcgccgattatcatcattaccggcgagcagttgagcagctatgaatatggcttgctgcaagtgcctattttcggggcgttaattgcgggtaacttgctgttagcgcgtctgacctcgcgccgcaccgtacgttcgctgataattatgggcggctggccgattatgattggtctgttggtcgctgctgcggcaacggttatctcatcgcacgcgtatttatggatgactgccgggttaagtatttatgctttcggtattggtctggcgaatgcgggactggtgcgattaaccctgtttgccagcgatatgagtaaaggtacggtttctgcggcgatgggaatgctgcaaatgctgatctttaccgttggtattgaaatcagcaaacatgcctggctgaacgggggcaacggacagtttaatctcttcaaccttgtcaacggaattttgtggctgtcgctgatggttatctttttaaaagataaacagatgggaaattctcacgaagggtaaaaaaatgcctgactgctttgtgcgatcaggcattctcgaattaatggtgatggtcgtcaatctggtgttcgataaccatcccttcacctacgctggcaagatggcgagcataaggatgcgggcggtaagccggagctggcgcaggagccacatagacggtttgcggcacagtcgcgacgctgaccgcttgtggaacgctgactgaatcaggaactacaaccactttgtatccactcggcacatcgacggtgacactttgcgccatcgccacaccagtaaagcccattaaaagcgcgcccaacagtagacaatttttcataatcatttcgcctgaaataatgcagcgggttaatttccgcgaattatgcagccttcattcaggtattgtgttgccgggcgtgctgccgtttttattggtcaaatggcgcttcgtgtttaagcactttatcgatcacatccagtacgccttcacggttattggagcctgcccggtattttgccgctgcgacgaccgcgctgccggcattttccattgcaaaactaaagcctgcctgacgcagcatctcaatatcgttaccgccatcgccaaagaccaccacttcgctgtcgtctattccccataatttctgcagttggcgaaggccattggctttatgtacgccggggataatcagatcgatgctgccgttgccggtgtggactggcaccataatatcgccgatggcctcatgtaatgctttttgtacttgtggaatcagttcatcggaaagattcaggccaaacttaaagaaaatatcttctaagttgtcaaagttatcgacgtattccagacggtgataatacatttccgccaccgttttcatggcatcgtcatattttttgagcgtataggcgctattttttccgcaggcaataatttccacttccgggcgcgtcagcaaatgttccacgacagtagtaaaggcatccttcgacagctcgccattaaaaacatctttgccttcactcactacccagccgccgttttcagccacaaaggcaatttcattagcaatttcagggaagaaagagatcaactgataatattgattcccgctggcgaccacaaagcgaatgccttgtgctttcatttgctgatactgagccataaaccgctcacggtcataggttttttgatcgcttaagaaagtaccatccatgtctaccgcaattaatttaatgctcatcaactattctccatcgccgtctgcgttttggtatcgggtttggcgacggctttcgcgacaatagccgcgagaataaccagcgccagtacaaccagcattgcactacgtaatccataatgttcgccgagatagcccagcagcggcggcccgacgaggaaagccagataaccggtcgttgctaccacactgacgcgggttggtgcatcggggccggtatcgctggcggcagaaatggtcagcgggaagcccagcgaggcacccattccccagagtacaacagacaccccagcgacccaggcgctatcgacaaaaataatcagcccaatacccaacgcccccattagcgcactggcccgaaccacggcaacgcgactgtaacggtcgatgaaccaaccgccagtgaagcgtccaacggtcatccccagggtaaaaccggcataaatcagcgagccggaagtggggctaaaaccgtgaccgtcaaccattaataagggtaaccagtcgttggcagaaccttcggcaaaggccatcgccagcaccacaacaccaatcagcagcaactggatatcgcgataaaaaggtacgcctttttcgccatgctgggtgccatcggcagcatttttgcccgtaccgtcagggattgcctgaatggcgatataaataggcgcgatacctaccagcgccgccaataaaatgtgcaccgttgccggaacgccaaaggccgtcagtgccatcccgacaccagcgcctgccagcgtgcccaggctataaaaaccgtgcatcatcggcaaaaccgttttattcatttctcgctcaacggcggcaccttcaacgtttatcgccacttccgcagaaccaaaacttgccccaaagacgccgagaccaacggcaaagagcaggggcgatgtcagccagagtgccagacttaatatcatcatcccgatcaatgcgcaggacatcgtgaccaggatgacattacgtgtcccaaagcgtttcactaaccacgccgagcagagaataccgctcatcgaaccgatcgacagaccaaagagaacaccgcccatttcagcgatcgagacagagagaatatcgcggatagcaggcgtacgggttgcccaggacgccattaacaggcctggcaaaaagaagaacataaacagcgcccaggttcggcgtttcaatgcattacgtgaagaatttacggtcatagatcacgtcaaaataagaagagggaagacaacattagcaaggttgtgtacatttgtacacaattgcagacagaggaaatgacatgcgtcgcgctaacgatccgcaacggcgagaaaaaattatccaggccacgctggaggcggtgaaactttacggaatacatgctgttacgcaccgcaaaattgctacccttgccggggtaccgttgggatcgatgacctactatttttcaggaattgatgagttgttgctggaggcgttcagcagttttactgagattatgtcccggcaatatcaggcattttttagcgatgttagtgatgctcaaggcgcatgccaggctatcaccgatatgatctacagctcacaggttgcaaagccggataatatggagctgatgtaccagctctacgcgctggctagccgaaaaccgctattaaaaacggtaatgcaaaactggatgcagcgcagtcagcaaacgctcgaacaatggtttgaacccggaaccgcccgcgcgcttgatgcgtttattgaggggatgacgctgcattttgtcaccgaccgtaagccgctatcgcgcgaggagattttgaggatggttgagagggttgcagggtagtagataaattttagataacaaaaaacccatttatgtaaatgggttaatgaaaacaataagttagagtaaaaacaataagttgggttggtggtcagtggtggttattacggggtaatgccaaccgctgccgccactttgtcgccacttgttttaccttagacgccaggggcctctatcttcaatctgttcgactaacccctcctcttctagttcacgcaatagtgcaacaacccaatattgttggttcgaacttgttgctttccgtttttctccccaatcgaggccgcttagacgaaatacctcagcttgcttaacgccgttgccgtttttttgggcatctgggtgagttttaagtacggataaagccaattctttggctctgttgcgcaattccgctccctgatgctgaaacttattcattgatagtgctccatgtgaaaaaaagaatattagctcaacagggcaaaatacgcattttcaaaaacttgctattgatgttggtagtgttgccagcggattaaaccgtaatgcagtttccaggtgatccggtgccagatgtgcgtaacgcatagtcatttttatatcgtgatgcccgagaattttttgtaaggccaggatatttccacccgacatcatgaagtgcgccgcaaacgtatggcgcagaacgtgtgtcagttgaccgcgagggagcacgatagacgttttttccatcacggataaaaattgaaaatagcagtctgtaaagaaattgaacccatcaagcgccatgatctcttcgtaaagctctttactgatagggatgcttctgtttttcttccccttcgttcttacaaaggtaattcggtatttggtcacctgtgagcgggtaagatttacggcttcacgccaacgtgcgcctgtgcttaagcatatcttaactaccagtgccagaattgggtcctgacgtttgcaatcagccagcaattcaacaatctgctcatgggtaagccatgccatctctttttctgcgatggtgaattttcgcatgttctccagtgggttcggatacgaccattcgcccaggcgggatagttcgctaaaaacactacttagatagctttgctccaggttaatggtgaccgggcttgctcctttcttccatttctcgctgaagtagatctcacctgtcaggcgtttatctcgatagtgggcaaacattttagatgtgagatcagttgcaaggggattgcccagagcgtcaaccatcagcagcaatttgtcatagacatgctgcccagcagtcagtgatttaccatgtagtttgaaccatagctcaaccacgtctttcagtgttcgacgatccactgattcacccagccagggctttgcttcggtttcttccatcgtgtgacgctcaaaagccagtgcttcgcctttggtggcgaattgtttacgcacacgacgcccactacgtccggcggggtaacattcgcaaagccattttcctgtggtgagttttcgtacagccataaaaaatgccctccaatagagagcatttttactgtatgtataaccagtgtcaatgtatgaaatcctgcgaccatacatctcactgaagccataatgaagtaggctattctttttgctatgtgagcatgtaacttttgcggttaacctgtggctcatttttattttaggcgcagatataaaagcaaaagttatcgtgagtttttagtacagatttttttggatttactaatagttccatcattgcaaacgaatttgccatcagaggtacagtgagaaacacctccctttttccctgagcagggataatttctagcataggtagctagtgggtttaataacaaagaacatgacaaaaccacaaaaaataccttaccaagcataatttcctcccggtactatttaacatacttgactgttaagcttataattttaccaattatttcaatgtcttctatcttgcattcgaaggctctgtttccaccctcgacgaagattcttccaccgggtaaacgagtaatgtcacggatcgttatttcgccatcaatacttattacccatttaccatcacgtatatcatcaaattccttatcacaaataaattcagaattattatctgtgattacaaaaagattcttgaatgccgacggtagaaattctctatcgaaaatataaaaaccgtcttcacacaaggccccatcagataatacatatttagcaacttccatagtatttgtattacctgaagtttgctttgaaccatgcccggttgtgagccaattaagcgaggtgcctgtttcaagggcgcactggattacccattctgctgggaatgagtcacgcatgtagcgtgtggcgagtgtacttttagagattcctaaatgatcgcacaacgcctgtcgagtcttgaatccataagcttctaccatgcgctctatagcgcctcgtccgcctttctccaaattcatggtcactccaagtgaacttttatcttgacgatttcactgtgcgatcgtatgtttatggtgttcacaaaatacaaacgatccgtattcgtcctgattaatcatcattaaacgaggaatgttgcatcatgagacctaacatttcaatcactcttaccacgcctcatgtgactattgaacgctatagcgagctgacagggctatccatcgataccatcaatgacatgttggctgatggacgccttatccgtcaccgtctgcgcaaagataaaaaacgcgaaaaagtgatgatcaacatagcagcaatgaccgttgatgcgctttcagaatgcaatctaaaccttaattagttcgattctgagatacatcagaggcattgaccatgtttgattaccaagtttccaaacatccacattttgatgaagcctgtcgtgcattcgcattgcgccacaacctggtgcaactggcagaacgtgctggcatgaatgtgcagattctgcggaacaagctgaacccagctcaacctcatttattaaccgcaccagaaatctggctgcttaccgatctgactgaagattcaacgctggtagatggttttctggcacagattcattgtctgccatgtgtaccgattaatgaggtggcaaaagagaaactgccacattacgtcatgagtgcaaccgcagagatcgggcgtgttgctgcaggtgcggtatctggcgatgtaaaaacctgtgccggtcgtcgtgatgctatcagcagcattaactctgtaacacgactgatggcgctggcggctgtttcattgcaggcccgtttacaggctaatcctgcgatggcgagtgcagttgataccgtgactggcctcggtgcttcattcggtttgctgtgaggtgcttatgctgacgaaagaaccatcatttgcatcgctgctggtaaaacaaagcccggcaatgcactacggtcacggctggatcatgggtgaggatggtaaacgctggcatccgtgccgttcacaagatgaattgctggcagaactatctacgaaaaaacgggggaacaaatggctattgaaggcactgcggcgactgttccattaagccccggtgaacgcctgaatggacttaatcacattgcggaattaagggcgaaagtttttggcctgaatattgagtcagagcttgagcggtttattaaagatatgcgtgatccatgggatatcaataatgaacaaaataaaagggcactggctgccatattctttatggcaaaaattccagctgaacgtcatagcaccagcattaatgagctgaccactgacgaaaagcgggagttgattaaagcaatgaatcattttcgtgcagtggtgagcttatttcccagacggctaaccatgccgaattaaccaactaatgaaattaatggcgtaaacccgccgggcatccctttatctaaattcaggagaattgattatgcgtaatattgaaatcctcacgactaaaaccggaccggatgacgcagggcttaatattttactgacagaggctcgtctggaagaacgccgggcaagggctgaagcaatggcagctcgccttgatagcctggcgtgtcatatcacatcccgccagctaaaccacgtcgaagcagcagaactgctgcgtgtgactgctgaagcaatccagagcgaagcgcaggagatccactaatggctgatgcaatggatctcgtacagcagcgcgttgaagaagaacgccagcgccatatccgtgctgcccgtgccaaaacaccgggcgtgtctcgcgtgctttgtattgaatgtgaagcgccaattccgccagcacgccgccgcgccattccgggtgtgcagctttgcattacctgtcaggaaatcgcagagctgaaaggcaaacattacaacggaggtgttgtatgagcaccatcctgaaatgggcgggaaataaaaccgccattatgtccgaactgaaaaaacatcttcctgctggcccgcgactggttgaacctttcgcggggtcctgtgctgtgatgatggagacggattatcccagctatctggttgcggatattaatcctgatttaatcaacctctataaaaaggttgccgctgattgtgaatcgtttatatctcgcgccagagttttatttgagatcgcaaacagggaggtggcttattacaacataaggcaggagtttaattactcaactgaaattactgatttcatgaaagcggtatatttcctgtatctcaatcgtcacggttaccgtggtttatgtcgctataacaagagcgggcatttcaacattccctacggtaattataaaaatccgtatttccctgaaaaagaaattcgcgcatttgcagaaaaggcccagcgagcaacgtttatctgcgccagctttgatgaaacgctggcgatgttgaaggcgggagatgtggtgtattgcgatccgccgtatgacggtacgttttccggctatcacactgatggtttcactgaagatgaccagtatcacctggcatccgttcttgaacatcggtcatcagaaggacatccggtcattgtttctaacagtgacacatccctgatccgttcgctgtatcgcaattttactcaccactatatcaaggtaaaacgcagcatcggtgtggcagctggcgagggtaaatcagcaacagaaatcattgctgtttccgggccgcgctgctggatgggatttgattattcgcgtggcgtggatagttctgccgtgtacggagtacgtgcatgagtcatgccgatatgaacaactgctgcggctttaacgaggctgccgcagcgttctcatggaacagcccgaaaaaggccattaacccttatctggacccggcggaagttgcgccggtttctacgctttcaaacctgatcactctgtacgctgccgataacgagcaggaacagttgcgccgcgaggcactgagtgatcaggtctgggagcgttatttctttaatgaatcacgtgatcctgtccagcgcgaaatggagcaggataagctcattagccgggcaaagctggcgcatgagcagcagcgttttaattcagacatggtcattctggcggacgtcaacgcccagccttcccatatcagcaagccgctgatgcaacgtattgaatacttcagcagcctgggcaggccaaaggcttattcccgctatttacgtgagacgattaagccatgtctggaacgactggagcatgtacgcgacagtcagctatctgcatcttttcgctttatggcaagccatgaagggctggacggcctgctgatcctgcctgaaatgagtcaggatcaggtgaaacgcctgtccaccttggtagctgcgcatatgagtatgtgccttgatgcagcttgtggtgatttgtatgccaccgatgacgttaagccagaagaaatccgcaagacatgggaaaaggtggcagcggaaaccctgcgtctggatgtcatcccgcctgcgtttgagcaactccgtcggaaaagaaaccgccgtaaacccgtgccctatgaactcattccgggttcgctggcgcgtatgctgtgcgccgactggtggtatcggaaattgtggaagatgcgttgcgaatggcgggaagagcagttgcgtgctgtctgcctggtcagcaaaaaagcatctccctatgtcagctatgaagccgtgatgcataaacgtgagcagcgccgtaagtcactggagtttttccgttctcatgaactggtgaacgaagacggagacgcgctggatatggaagatgtggtaaacgccagcagcagcaacccggcgcatcgtcgcaatgagatgatggcctgtgttaaaggtctggagcttatcgcggaaatgcgcggtgactgcgccgttttctacaccattacctgtccgtcacgtttccattccacgctcaataacggcagacccaacccgacatggacaaatgcgacggtaagacaaagcagcgattatctggtcggtacgtttgctgcatttcgtaaggcgatgcacaaagccgggttgcgctggtatggcgtgcgggtggctgagccgcatcatgacggcacagttcactggcacctgttgtgtttcatgcgcaaaaaagaccgccgcgccattactgcattgttgcgtaagtttgctatccgtgaagaccgtgaggagctgggcaataacacggggccgcgctttaagtctgagctgattaacccgcgaaaaggaacgccgacaagctacatcgcgaaatacatcagtaagaacattgatgggcgtggtctggctggcgaaatcagcaaggaaacgggtaaatccctgcgtgataacgctgaatacgttaatgcctgggcgtctctgcatcgtgttcagcaatttcgcttctttggtattccggggcgtcaggcgtaccgtgaattgcgattgctggctggtcaggcggcaaggcaacagggtgacaaaaaagcaggtgcgccggtactggataacccgcgccttgatgccattctggctgctgctgatgctggttgttttgccacctacattatgaagcagggcggcgtactggttccccgcaaatatcaccttatcagaacagcttatgaaattaacgaagagccgaccgcctatggcgatcacggtattcgtatttatggcatctggtcacccattgcagagggcaagatttgtactcatgcagtgaagtggaaaatggttcgtaaggccgttgacgttcaggaggcggcagccgaccagggcgcttgcgccccttggactcgtggcaataactgtccccttgctgaaaatttgaaccaacaggagaaagataaatcagctgatggggaccccagaacggactttacccgcatggatgacaaggagttgcacgattacctgcacagtatgaacaaaaaggagcgccgggaactggctgcaaggttacgtctggtgaaaccgaaacggcgtagagactacaaacagcgaattacagaccatcaacgacagcagctcgtctatgaactgaaatccagaggatttgatggcagcgagaaagaggtcgatttactccttcgcggcggcagtattccgtcaggagcaggcctgcgtatcttctatcggaaccagcgtttgcaggaagatgataagtggcggaacctgtattaattacgctggttaacaattcgtgctcttaataataccaggcatatcaagctgataagcgtaaaaaaaacgttttacatcagtaagattattatatactgtaaatataaacagtggttatacatacagtatttcttgtggtgtcataggaggaaagatgcaggactattttttggagtctttgaagctccagcgcattgatttttttcttaagcttgtagcggctagtgagtgtagtgatgaagagaaggggctggctctgcagtgggtttctgaattgactgatgaactcatggcaaaaatcagaagccacgaatacaaccgctcaatggatgtcatcagctgaggtgacttttatgcgcattgaaataatgatcgataaagagcagaagattagccagtctaccctggacgcccttgaatccgagctttaccgcaatctgcgccccctgtatcccaaaacggtaatccgtatccgtaaaggtagctctaacggtgtggaactgaccggactgcaactggacgaagaaagaaaacaagtgatgaaaattatgcagaaggtgtgggaagacgacagctggctgcattgattttgtcaatagacgcttgtttttactaatcaaaaagggttacatatgagtgagaggcgatgtcaatcggatatcgccttgttttttgtcaagaaaagaataataggctaaaaatgaaaattaataatgtagcgttaccaatatctcttgctgtaatcctaactggttgcgtgccacatgcttctaaccgaaatatcactgctattgaagtggtgaagcctgctattgggcaaagtgctaccgcctacatgggcgatcccattatcacatctgctactggatttaaaacggacgtactagaacttggtgcggctaatggtgcattgtcttctatcgctgctggtacatattgcagtgaggggaatggaatttaccgcaattatcataaccctcaagctgttgcgttaaaaaatctctatgggcaaatcggtaactatgttgattatgttagttacgatgctgcaaaaaatgagatatcaccgccaaatggtacttcttatactgcatcagaaatttctatcaaacgtgttcctgatgggctgtgtcgagttagtaactcattggttaagactatcgaatacaatggaaatgcaggcggtgtaatgaagttcacctatcgtgaatttgcaaacgatatggctcgtgcagcatttacaacagatttttctgtagattctaagggaagtgacgttatcgcttacaaaggtgccaagttcaaagtgaacaaggctgataactcgtctatttcttatacaattatttctggctttgacaaggctgtcacgttctagttttcacgcttactgagtatgttacgattttgcacattctgcataagcgcgcatgtctatgctgcatgagatcgcatgatcgtttgaggatcttttgtgttaaggcccgccagttctggcgggcttttgcgtagatcatgcaggtgcatgaaaaccactacataaagcgggcaggcgtggcggggatacgagcgcgcgcaataagtgtttataccaaaatattgtcttatgatatctttatcggattactctggaagttctatagcgtcataaaggatttttttaatgaacgaaaaactaactgaattaaaagagaaactagataatttacatacaacacttaatggtcttgtattccctgtggaagattttataaaccttgggccgtacacatttccttttttacataaagatgatctgatagaactaccaaaaatgttatctgatagaattaatcagatgcaggaatttgtaccatcttcagatgacattgcagtaattgatgcgctcatttacactctggatcatgctcagcaaaatattaatcatataaacaatggtaacgcatcagttcaacagaccgctataccatcttatgttatttcaatgttatatatctctcataggattaatgaccttttttcatttgagaggctgaaagatagaaatttattaccaaagcaaattttacgcagattagaattatataattcaggtatatctgcaattgcagctgaaactggtaatatagaagagaaaattaaaactataaatgaagcatatgatgcagccgagaatctaccgacaacagtaaaaatgcttcgtgaaacaaatgatgaagttaaaaatgtttacaatagcgcagttgagcattgcagaaatattaatggcatgcttaaagagactgaagagaactccaaaatcgtagatgaggccagacaagaaattttggcgctgaaacagaatgcaagcaaggatgcaaaagattatttacaatctctccgtgaagaagctcagggttatattaataaatgtgaagaggcatttagaactactacttcaaaaggtttggctggggcatttcaagataaagcagaaaaattaaaccggagcatacgttggtgggtatgtggactaataggtgctttggttgcaggtgctgctgttggttatacgcgtttacatgctctcgaagcatatctgtcaaaccctgacgcatcaggtataaagttagctattcaacttttactctccattttaagtgttggagcaccattatggtttgcttggttagcaacgaaacaaattggtcagcgattcagattggcagaggattatgaattcaaggcctcagtatccaaagcttatgagggatatagaagagaagctgtccaacttgatagcgactttacccaaaggttatttggtaatgcacttactcgactggaggagccgccattaagatttgttgaagaagctacccattcatcgcctataatggaaatgttatcatcggaaaattttaagcatttcttagctaatggtggcgataaaatcgattcaattttagaaggtgcaggcctttctagaaaaggtaaagtcgaacaaacgcgccattttaataaggatgtgatccagcctgtaaatgaaacttcaaacaaaccagaaaatgattaaaaataggggcgttagccccctatttcatcaaagcatatactcattaaaattaattacatcatcatctaaccaagtgttcagttccagtatttttttttgtaatactgttaactcatttctaacaaatactttgcaggctttctccacatccccaaatcccccaacattattaggcattatccccatcatttgtggcggtacacggtgcgcagccatcatgtcgtcgcggctgacatttttgatattcagaaattcatccttcgccgcgacttctgacaacgggataatctgaagaccatcctttttgccgttaggtgagtacataaacaggttgcggaagttgcctggacctttggcgcttttcattgcgttgcggaggttgttcacatcctcctggttctgcgcagcatcggtcatgtacatgatgaagccagcatgactgccgttaatgtaatactttcggcggaacagcgtggcggactcgttgagcagggctgacggaatggcagaaagataaccgggcaggccgtagatctcctggttgatgtccggttccatcagatgaaagatgctgcctttcgtgaactgatatggctgcgtggtcataccgtattgcacaaaccagtaggtatccaggtctaacccgcgtcgggtatattttgccagggcaggttcaagggcgataacttcaccgaagcggttcgtgcgtttctccaggtaggcgttaccaaataccagatagtcctgcacaaaacgcgaaaaagcctgctggctgagcagcgggtgagggatgtaggtgctggtcagaatgttgcactttactgcaatcggggaactatgatgcacggcagcgcggaaggtgcgcgccagtccgtcaaagctgacgggcggctcataccagcggtccatctgtacgcattccacataatccagcagttctcggcggtccagaacaggaacgggatcgccgaagctgaatgcttcggctgtagtttgacttttaagctggatctgtttcgtcgccgcagcgcggttcttcttactctttcccatcaaaaaatctccacaatattgctggtattggcggactcgccctgcagcggttcgttaaacagtgcgtgcattgttgcccaggccagatcggcatggctggcttcttcgctgcggctggcttcataggtcgggcggttgccgctggcggtggtggcgcgacggattgccataaatgactgcgctatgtcggtgtgtccggcgtcaaactccagacgacggtgactgataatgtcgtaggctttgagtaccagggcatttttaacgttggggttgtagacaaactcccggacggcaggaaagaacgctttcacgttctcgtaaaccccgtgaccgacacctgtcgagtcaatgccgatgtatgtcacgttgtactgttcggtcagttttttgatggcgtcagcctgggcgcggaagtccatcccgcgccactggtgacgctcaagaatgcggaacttaccgcccggcacggctggcggtgccaccaccacgcacccggcgctgtcgccgttttgcgtaccttttgccgggtcataaccgatccacacttcgcgccagccaaacgggcgcagggccagtgcatgaaagtcggtccagacttcccaactgtccaccatgcacgcctgcagctcgctgagcgggaacacggacgcgagatcgtccacgaactcacacatcagcaggttctggtattcgtccgggctgtactccatgcgcaactggtcgaggtcgaacaggttacagccgccgcgcaccgcatcttccacggtgactatctggcggtattgcccgtctgcgcacagcaggccgggggccagattgctgtgggacaggtcgatgtccaccttgtcagctttgttgcgcccacggttgaacagcgcaccggaccagaacggataagcactgtgggtcagactggatggcgtggaaaaataggtttgtcgccattttttgtgaatagccataccggaagccactttgcgcagctcctggaattttggtatccagaaatattcatccagatacaggttgccgtgataactctgggccgtgcgggcattggtgccgaggaaatacagtgtggccccgttgggaagcaccatcggatcgcctttcagctccacctctacttctttggcaaagtcgatgatgtactgtttgaagacgtgggcctgtgccttactggcagaaaggaaaatctggttacgtccggtcagcagggcgtcaatcagggcttcacgggcaaaatagaaggtcgcgccgatctggcgtgacttcagcaggttgcggatgcggttggtttttccggcttcccaccagtggcgctggtagttgaacatggaggaatggaagatttcttccagcttctcaatctgttcatcggtgaagacatttttttccggctgacggcgcgggcctttgttgcggttggcgacgttagggttcaagtcggcttcgttgccgccattgttaaacttgccgatccgcgcgtggcgctcagactggcgcgccagcaggtcaatctctttgaaatctttcccttctttgtgctccttcataatgagctggcagtagcgtgcggcggtggtgagctgcatctgatccagcggcccatagtcaccccacttgtcgcgttttttccagctgtgaacggttgcaactttctcgcccagcatttcagcaatgcgggctacgcggtatccctgaaagtacagcagcatggcctgccgacggggatcgagatctgcgggtgtcagtgtggtgttcatggcacaaacctacagccttgaatgaaggctttccccgcctgcggtttgtgtggttgtcggtacaaataccgcgcattgtttcactgcccccatcaccgcaaccataaggctccagtaagttttttctaacggagcacggctcatgacagtgaaagcaaagcgttttcgcatcggggtggaaggtgccaccaccgacggacgcgaaatccagcgtgaatggctggaacagatggcagccagctacaacccggcggtgtataccgcgctgattaaccttgagcacatcaagtcttatctgccggacagcacctttaaccgctacggcaaggtgacggcgctgtttgctgaagaaatcacggaaggtccgctggcaggcaagatggcgctgtatgccgacgttgagccaacggagtccctggtggaactggtgaaaaaaggccagaaattattcacctctatggaagtcagcccgaagttcgctgatacgggcaaagcctacctggtcggcctggctgccactgatgatcccgccagtctgggtacggaaatgctgacattcagcgccagtgcagcccataacccgctggcaaaccgcaagcagaatcctgccaatctctttaccgctgcagaggaaacggtgatcgaactggaagaaatccaggacgacaaaccgtccctgtttgcccgcgtcacggcgctgtttaccaaaaaagagcagtccgatgacgcccggttctctgatgtgcataaggccgtggagctggtcgccacagagcagcagaacctgagcgcacgcaccgaaaaatccctgtctgagcaggaagaacgcctgtctgagctggagactgccctgcaggcacagcagaccgcctttaacgaactggtggacaagctgagtcatgaagacagccgccaggactaccgtcagcgtgcaacaggcggtaacgcccccgctgacactctgaccaattgctgatggagcacaaaacccgatgaagaagaatacccgctttgcttttaacgcttacctgcagcagctggcgcgtctgaacggtgttgcagttgaagaactgtccagcaagttcaccgtcgaaccgtccgtgcagcagacgctggaagaccagatccagcagtccgccgctttcctgacactgattaacgtcacgccagtgactgagcagtccggtcagttgctggggctgggtgttggcagcaccattgccggaaccactgataccaccgcgaaagagcgtgaacctgtcgatccgacgctgatggtcgatgtggaatataaatgcgagcagaccaactttgacacggtgctgacctacgcgaagctggacctgtgggcgaagtttcaggatttccaggtgcgtatccgtgacgccatcgtgaaacgtcaggcactggaccgcatcatgatcggctttaacggcgtgaagcgtgcgaaaacctccaaccgtagcgaaaacccgctgctgcaggatgtgaataaaggctggctgcagaaaatccgtgaggatgcaccggatcacgtcatgggcagcaccaccacgggcggtgaaactacaccgggtgcggtgaaagtcgggaaaggtggcgaatatgccaacctggacgccgtagtgatggatgccgtcaatgagcttatcgacgtggtttaccaggacgatgacgatctggtggttatttgcgggcgtgaactgctgtctgacaagtatttcccgctggtcaacaaagagcaggaaaacagtgaaaaactggctgccgatatgatcatcagtcagaaacgcatgggtggcctgcaggccgtgcgtgcgccgttcttcccgccgaatgcgctgctaatcacccgtctggataacctgtccatctactggcaggaagacacccgccgccgttcagttatcgacaacccgaaacgtgaccggattgaaaactttgaatccgttaacgaagcctatgtggttgaggactaccgctgcgccgcactggtggaaaacatccagattggcgatttcagcgccgccgtagcagaaaccggagagtaatccatgagcctgagtcccgcacggcagcatcgcctgcgcgttcaggctgaacaggccgcccgcgagggcggcagtgttcgccacgcatcgggctatgacctgatgctgctgcaactggcggaagaccgccgccgtctcaagggcgttcagtccacggtcaaaaaagcggaaatcaaggtggagctgctgccgaagtacgccgcctgggcagagggtgtcctggctgccggaggcgctcaacaggatgacgtgctgatgtacgtgatgctgtggcgcattgatgccggagattatgccggggcgctggagatcgggcgtcatgccctgcgtcatggctgggtgatgccgctgggtaaccgcaacgtgcagaccgtgctggcagaggaaatggcagacgccgcgcagagcgcaatgcttgccgccaccggctttgatgccgatctgttgctgcagacgctggagctgacagacggtctggatatgccggaccagtcacgggcgcgtctgcataaagcgattggcgctgtcctgagtgaaaacaatccggcttccgcccttaatcatctcaaccatgcgttacagctcgatccccgctgtggcgtgaaaaaagacaaacagcagctggagcgcagactgcgcaatgacagccgctgacagaacgtgcccccgcgcacgggcggcacggggtggcgaaaggcactgccacatcaaaaccccgtccaccgccctctatttcaggagaaagcagcatgaagtttgttgcgctagaacaggcaccggaacaggcggaaatcatcagaaatacgccgttctggcctgatgtggacctgtcggagtttcgcagcgtgatgcgcactgacggcacggtgacgcagccgcgtttaaagcaggttgcgctgtcggcaatttcggaggtcaacgcagagctgtatgagtttcgcagacgtcagcagatgctggggtatgtgtcgctggctgaggttccggctgaacagctggacggcaaaagtgagcgcattcagcactatttcaacgcggtttactgctgggcacgcgccatgctcaacgaacgttaccaggactatgacgccacggcatccggtgtgaagcggggcgaagaactggcagaagccagcggtgatttgtggcgtgacgcccgctgggccatcagccgggtgcaggatgcgccgcactgcacagtggagcttatctgatgaaagtgcgtgcgcatcagtatgacacggtggacgcgctttgctggcgtcattacgggcgcacgcagggtgtcacggagcaggtactgaaggcaaatccggggcttgccgaatacggcccctttttacctcacgggctgcaggtggagctgccggacattccgaccaccaccaccgtgcagaccgtccagctatgggactgaattatgacgcttgagcgaatcagcgcctttatcacgtattgcatcgccgtcgtgctggcctggctgggcgatttgtccatcaaggatgcctcaacgctgggcggcctgatgattggtgtgctgatgctggctatcaactggtactacaaacacaaagcctaccagcttctgcgcgacgggcagatctcgcgggaggactatgaatccatcaatcgttaaacgctgccttgtcggggccgtgctggctattgctgccacgctgccgggttttcagcagcttcacacctccgtggaggggctgaaactgattgccgattacgaaggttgtcgtctgcagccgtatcagtgcagcgcgggtgtctggaccgacggcattggtaatacgtcaggcgtcattcccggcaaaaccattacggagcgacaggcagcagaagggctgatctccaacgtgctgcgtgtggagcgggcgctggaaaggtgtgtgaagcaacagccgccgcagaaggtgtatgacgccgcggtgtcgtttgccttcaacgtgggaacgggcaatgcctgcagttccacgctggtgaaattactcaatcagcggcgctgggcagatgcgtgccgacagttgccgcgctgggtttatgtgaaaggtgtttttaatcaggggctggataaccgccgtgcgcgggagatggcctggtgtttacagggagcaaactgaaatgaaaaagaaattaatcagcggactgtttctgatgttatggatggcgctgttaatcgcagcaatggtgtatccgcaggggatttttccggtactggcagcgtccggcgtttgggtagcctgtttgctgacatgggcggtaattccggtagcactggctgcgttaattaagaatggcccgctctggcaggagttaagggcatctttgctgaagacaattacccgaaaagaaaacgtatttaccagttgggtgatgcgattgctgattgttgtaagtctcgcctggacggggtgggctattaccctggtcttttatctactgaccgttattgccttctggatcacccgtaatcagatggcgcaacaggtagcagcatgaaccggttgctgctggttgtgctggcgttattactggcggcgctgggctggcagacgtggcggctggctgatgccagccagaccatcagcacgcaggcagacgagctgcagagcaaaagccaggcactggcaaagagcaacagccagcttatcagcctgtccattctgactgaaaccaataaccgggagcaggcgcggctctatgccgaagcagaacagaccagcgcacagctgagacaacgacaacgccggatcgaggaactgaaacgtgagaacgaggatttacgccgctgggctgatactcctttgcctgctgacattatccggctgcgggaacgtccggcactcaccggaggtgcagcttaccgtcagtggttgtccgcgagtgacgccgtgtcggctggagcaggcagcaccgcgcactaacggtgatctgaatgcgttgctggatgaaacggaggccgcctgggcggtctgtgcagacaaagtggacatgattattgcgtgtcaggagcgaaacagtgaacaaaccacagtccctgcgccacgccctcaataaagcagtgccttatgtccgcaataacccggacaaactgcatctgtttgtggataacggttcgctggttgccacgggggccagctccatgtcatgggagtaccattataccctcaacgtggtgattgaggatttcagcggcgaccagaatctgctgatggccccggttttgctgtggctgcgtgataaccagcccgatgccatcaataacccggcgttacgggaaaaactattcacctttgaggtggatattgtgcgcaacgatgtctgtgatatcagccttaacctgcaactgacggagcgtgtgctggtcagtactgacggcagtgtgtcgagtgttgaagctgtagcggaacccgataaacctgaagaaatgtggacggtgaaacgtggctgaattgcagaaggtggacgactggctgagtgccttgctggcgaatctggagccagccgcaagaagccgtatgatgcgccagctggcgcaggaactgcgccggacacagcagcagaatatcaggatgcagcgcaatccagatggcagcagttatgaaccgcgcagggtaacagcacgcagcaagaaggggcgcatcaaacgtcagatgtttgcaaagctgcgcaccacaaaatacctgaaaactgccgccagcgccgactctgccagcgtacagtttgaaggcaaggtgcagcgtattgcccgtgttcaccattacggcctgcgtgatcgcgtcagtcgcaaaggaccggaggttcgttacgcagagcgccgcctgctgggtgtaaatgatgatgttgaggcaatgacccgcgacatgattctgcaatggctggcggggtgatctttgtatcagcactgatacaagttgcagcactgccgcctttcttcccctgatggcaacctttccctatgaacgcacaattaaccgaaatcatgcgccttatcaccaatctgatccgcacaggtgtagtcaccgaagtggaccgggaaaactggctttgtcgggtgaaaacgggcgaccttgaaaccaactggattaactggctgacgctgcgcgcgggtaatgcctgcacatggtggaaaccatcggaaggtgagcaggtggtgctgctgagtctgggaggcaatctggaaaccgcgtttgcgctgcccgccatctattcgaatcagttcgcgccaccgtcgacgtcggcggacgcctgcgtgacagaacatcctgacggtggctggtttgaatacgaacccgccaccgggcgctggtatgtcaggggcatcaaatcaatggtcattgaggccgctgacaacatcaccatgaaaaccaatgagtttgtactggaggctgaccgcacgcgcattaacagcgaagtggtgatcaatggtggcgttacccagggcggcggtgcaatgagttctaacggaattgtggttgatgcacatcagcatactggcgtcctgaaaggcggcgacacaaccggaggcccggtatgacgctttatagcgggatgaacaataccagcggcaaagtcattactgatattgaccatctgcgccagtcggtgcgggacattctgctgacgccgcagggtagccgcattgcccgtcgggaatatggttccctactgtcggcactgatagatcagccacaaaatccggcattacgcctgcaggtcatgtcggcagtgtatgtggcgctgagtcgctgggagccacggctgacgctggattccatcaccatcaacagcaactttgacggttctatggtggtggagctgaccgggcggcggaataacggtgtgcctgtgtccctttccgtatcaacaggagcagagaatggcagtgattgacctttcgcagttgcctgcaccgcagattgtggatgtgccggactttgagacgctgcttgccgaacgcaaggcagaatttgtggcgcttcatccgaaagatgagcaggaagccatgatccgcacgctggaactggaatctgaacccgtcactaaattgttgcaggagaacgcttaccgtgagttgcttctgcgccagcgcattaacgaagccgcgcaggcggtgatggtggcttacgcgatgggcggcgatcttgaccagctcgctgccaactacaacgtgacacgcctgacggtgacgcctgctgataatgatgctgtgccgcccgttgcagctgtgatggaaagcgatgaagcgttacgcctgcgtgtgcctgcagcctttgaagggctttctgttgcggggccaactgcagcttatgaatttcatgcccgaagcgccgacggtcgggtggcggatgccagtgcaaccagcccggcacctgcagaggtggtgctgactgtccttagccgcgaaggcgatggaactgcagaaaaagacctgctggacgtggtggaaaaagctctgaacagtgagaacgtccgcccggtggctgaccgtctgacggttcgcagcgcagaaatcatcccgtatcgcgtggaagccaccatttttctctatccgggaccggaagcagagccggtaatggcagcggcaaaagccagcctgcagaagtacatcgccagtcagacgcgtcttggtcgggatattcgccgtagcgccatctttgccgccctgcatgttgagggtgtgcagcgtgtggagctggcttctcctctggcggatgtggtcctgaacaaaacacaggcggcatcatgtacgcagtggagcgtaaccaacggaggaacggatgaatagtctgctgccaccgggttcaacaccactggagcgccgactggcgcaaacctgcagcgggatttctgatctgcaggtgccgcttcgtgacttgtggaatccggcaacctgtccggtcagcttcctgccttatctcgcctgggcgttctctgtggatcgctgggacgagggctggacagaaagcgtcaaacgccaggtagtgaaggatgctttttatattcatcagcataaaggaaccaccagtgccgtgcggcgggtggtggagccgttcggctttctgatccgcattattgagtggtggcagaccggagaggcaccgggcacgtttcgcctggatatcggcgtgcaggaccagggcatcactgaagatacctatctggaacttgagaggctgataagcgatgccaaaccatgtagccgtcacatgatcggcatgtccatcaatctgcagaccagcggcccgtattggttgggggcagccagttatcttggtgaagaaatcacgatctttccgtatatcaacgaaacaattatttccggcggcaccgcgcatgaaggcggggcggtccatgttattgacacaatgagagtgaatccatgagcacaaaattttataccctgctgacggatattggcgcggcgaaacttgccagcgccgccgcgctcggtgtgccgttaaaaattacccatatggcggtcggcgatggcggcggaacattaccaacgccggacgcaaagcagacagcactggtaaatgagaaacgccgggctgcgctgaatatgctctatatcgacccgcagaacagcagccagattattgctgaacaggtgatccctgaaaacgagggcggttggtggatacgtgaagtgggcctgtttgatgagtccggggcattgattgccgtgggcaactgcccggaaagctataagccgcaactggctgaaggcagcgggcgtacccagaccgtgcgcatggtgctgattaccagcagtacggacaatatcaccctgaaaatcgaccctgctgtagtgctggcaacccgcaagtatgtggatgacaaaatatcagagcacgaacagtcacgacgtcacccggacgcctcgctgaccgcaaagggttttactcagttaagcagtgcgaccaacagtgaatccgaaatactggccgcaacaccgaaggctgtgaaggcggcatatgatcttgcagcaggtaaagcatccgccagtcacacacacccgtggaatcagataacggatgtgcctgcagcttcactgacggtaaaaggcaccgtgcaactcagcagcgccactaacagcacgtcagaaacgcaggctgccacaccaaaggcagtgaaggcggcatatgaccttgcagcaggtaaggcacctgtcagtcacacgcacccgtggagccagataacagatgtgcctgcagcttcactgacggtaaaaggcaccgtgcaactcagcagcgctactaacagcacgtcagaaacgcaggctgccacaccaaaagccgtgaaggctgtatatgaccttgccaatggaaaacaacctgccgacgccacactgaccgcactggcaggccttgccactgcggcagacaaacttccgtattttacggggaatgatacagccagcctgacaaccctgactaacgttggacggaatattctggataaagcaagcacacaggcggttattcaatatcttggtctgagcgatgcaagtggatacgttggacgctggctgaatacccaggttttcacctcatcaggtacgtacaccccgacgccaggaacaaaacggattagggtcacaataacgggcggcggtggcggagggggcggctgcaaggctatatccaataatgaaacgtttttcggtgctggcggcggggcaggtgggacagtaatcaccacgctgatcctgacgaaggatagttatcctgtcactatcggcgcaggtggggccggcggcgttagtgcgacgaacggcctcaagggcggtgatagctcgttcggatcggtaatagcccctggtggtgaaggtggtggaaaatcaggagtcacaaacacgaacggtggtaacggcggtgtgccaagtactggcggtatcaacatcattggtggaaatggaggcgacggtcagtccggaaatatcggcgtcagcggtgaaggcggaacatcgcactggggtggcggtggacgcgcaggcgctggcggtggtgttagtggtaaggcatatggttcaggtggcggtggcgcatacgatgccggttatagcggaaccagtatgacaggcgggaaaggtgccgctgggatttgtattatcgaggagtttgcataatgaatgcgtcatatgcagttattgaaaatgggatggttgtgaatgtcattgtctgggatggcgaggctgaattcacagtgccggataatcagcagctcattaatatttctgatatcagtgagcagcccggaatcggctgggtttattcagacgggggatttactgcaccacccacccaggaacgttctcatgatgaactggtagctgacgctgaacagaaaaaacagtcgctgttagacgcagcaatggccaatatcagcgtgattcagttaaagctgcaggccgggcgcaaactgacgcaagaggaaactacccgacttaacgttgtgctggattatatcgaggctgtgacggcaatagataccagcaccgcacctgatatcatttggcctgttttccctgcaagcagataaataccgtcattttgtgtgaataacggtacaactgcgcttagctgcttgtcagacacaatcacttcaacatagggcgaagcctaatccaatcaggaggttcgccactatggctcaggattaccaccacggagtgcgcgttgttgaagtcaacgaaggcactcgatccattactacggtgagcaccgccatcgtgggcatggtctgcacgggcgatgatgccgatgcaaaaatgttccctcttaataaacccgtgctgatcactgatgtgcttactgccagcggtaaagcgggtgagtcaggtacgctggcccgttcgctggatgccatcgctgaccaggcaaaacccgtgaccgttgttgtgcgtgtgccgcagggtgaaacggaagaagaaaccacgaccaatatcatcggagcagtgaccgctgaaggtaaaaaaacaggcatgaaagccctgttatctgcccagtcacagctcggcgttaaaccgcgcattctcggcgtgccaggccacgacaccaaggcggtagctactgagttgctgagcgtggcgcaaagcctgcgtggatttgcttacctgtcagcgtatggctgcaagacggtacaggaggcgatcacttaccgtgaaaacttcagccagcgcgaagggatgctgatctggcctgactttactggctgggacacggtgctgaatgccgaagcaacggcatatgccaccgcccgtgcgcttggtctgcgcgccaaaattgacgagcagaccggatggcacaaaagcctgtccaacgtgggcgtgaacggtgtcaccggaatttctgctgatgtgttctgggatctgcaggacccggcaaccgatgcaggtctgctgaaccagaacgacgtcaccacgcttgtgcgtaaagacggtttccgcttctggggttcccgctgcctgagtgatgacccgctctttgccttcgaaaactacacccgcacggcgcaggtgctgatggacacgatggcagaagcacacatgtgggcggtggataaaccgcttaacccgtcgctggcccgcgacattatcgaggggatccgcgccaaaatgcgcagcctggtcagtcagggctatctcattggtggtgattgctggctggatgagtcggtgaacgacaaagacacgctgaaagccggaaaactcaccatcgactacgactacacgccagtgccgccacttgaaaacctgatgctgcgtcagcgcatcaccgatcagtacctggtgaatttctctagccaggtcagcgcgtaaggggacaacatggctttaccacgcaaattaaaacacctgaacctgtttaatgacgggaacaactggcaggggatcgttgagtcgctgacgctgccgaaattcacccgcaaatatgagaagtatcgcggcggtggaatgccgggtgcagtggatgtggatctggggcttgatgacagtgcgctggacacagaattttccattggtggtactgaactgctgctgtttaaacagatgggcaaagccacggtggatggcatccagttgcgcttcaccggctctatccagcgtgacgataccggagaagtgcaggccgtggagcttgtggtgcgtggacgtcacaaagaagtggattccggcgagtggaagacgggcgaaagcaacaccaccaaagtgaccagtaccaacagctacgcgaagctgactatcaatggtgaggtgctctatgaagtggaccttatcaacatggtggaaattgtggacggtgtggacctgatggaagcgcaccgcaacgccctcggcctctgatgtatctgaacggcgcggaatgccgcgccagaacccaatttacaggacagcaaaatgagcgataagcagactgaaaagactattaaactggatactcccatcatgcgcggtaaaacagaaattaccgaaattgtgctgcgtaaaccgcagtccggtgcgctgcgcggcacacgcctgcaggccattatggatatggatgtgaacgcgatgatgaccgtgatcccccgcatctccagtccggcactgactgcacaggaaatcgcagagatggacccggcagatctcactgccatgtcggttgaggttgtcacttttttgttgaagaagtcggtgcttgccggtttaccgacagcctgacggttgacgatctggtggcagatatcgccaccatctttcactggccgccatccgttactgacgttatgccgctgaccgaagtgctggaatggcggtataaagcgattcagagaagcggggccaacgatgagtgataacaacctgcgtctgcaggtcattcttaatgcggttgacaagctcacccgcccatttcgatctgcgcaggccagttcaagagaactggctgctgctgtcaaaaaatcccgcgatgcaataaagcagcttgatcaggccgggagcagtctggacagcttccgaaagctgcaggcagaaaatcagaaattaggcgacaggctgaactatgcccgccagcgtgcaaatttgctcagtcaggaactgggagcgatggggccgccttcgcaacgtcaggttgttgctctgggccgtcaacggctggctgttcagcgcctggaagaacgccagaaaaagctgcagcagcagacggcgcttgtgcgtgctgaactgtaccgggcgggaatttctgcgaaagacgatgcgggagcaactgcccgtttagcccgtgaaacatcacgttataaccaggaactttcgaaacaggaggcgcggctgaagcgactgggggaagctcagcgcaggatgaatgcagcgcgtgccagttatacccgttcgctggaggtgcgtgatcgtattgcaggtgccggagccaccaccacggctgcagggctggcaatgggtgcgccagtgatggcggcagtaaaaagctataccagcatggaagatgccatgaaaggtgtggcaaagcaggtcaatggtctgcgtgacgataatggcaaccgcactgcacgtttttatgaaatgcaggatgccatcaaggctgccagcgaacagttgccgatggaaaacggtgcggtggacttcgctgcactggttgaaggtggtgcgcgcatgaacgtcgcaaaccctgacgacagctgggaagatcagaaacgtgacctgctggccttcgccagtacggcagcaaaggcggcaacagcctttgagctgccagcggatgaactgtcagaaagtctggggaaaatcgcccagctctacaaaatccctacccgcaatattgaacagctcggtgatgcgctgaattatctggatgataacgccatgtcgaaaggggcagacatcattgatgtgatgcaacgtctgggcggtgtggctgaccgtctggattatcgtaaagcggcggcgctgggttccaccttcctgacactgggcgctgcgccggaggttgcagccagtgcagcaaacgcgatggtgcgtgaattgtccattgccaccatgcaaagcaagagtttttttgaagggatgaatctgctgaaactcaatcctgaagtgattgaaaagcagatgacgaaggatgcgatgggaaccatccagcgcgtgctggagaaggtgaacgcactgccgcaggataagcgcctgtctgccatgaccatgttgtttggtaaagagtttggcgatgatgcggcgaaactggcaaacaacctgccggaactgcagcgccagctaaaactgacagcgggcaatgatgcgctcggttcgatgcagaaagaatccgacattaacaaggactcactttctgcgcagtggttgctggttaaaaccggagcgcagaacaccttcagcagcctgggcgaaacgctgcgccagccgctgatggatattctgtacacggtgaaaagcatcacgggggcgttgcgccgctgggtggaagctaacccggaactgacaggcacactgatgaaagtagcggctgttgtggctgcggttaccgtaggcctcggcaccttagcggtggcgctggctgcagttctggggccgctggcagtgatccgtctgggattctctgtgctgggtatcaaaacgttaccttccgttacggcagcagtaactcgaaccagcagcgcgttgtcctggctggctggcgcaccactggcactgctgcgacgcgggcttgcttcatcgggcaacgccgcaggtttacttactgcgccgttgtcgtctttgcgccgcacggcatcactgacgggaaatgtcctgaaaactgtagcaggtgcgccggttgcactgttgcggtctggattatccggtttacgtgcggttgctgtgatgtttatgaatccactggcagcaatacgcggcgggctggctgccgcaggcacggtgctgcgagtactggcatctggtccactggcgatgttgcgcgttgccctgtatgccgtatctggtctgttaggtgctctgctcagtccgataggtcttgtggttactgcactggcgggtgtggcactggttgtctggaaatactggcaacccatcaccgcatttctcggtggcgtggtggaaggattcaaagcggcggcaggtcccatcagtgcagcgttcgaaccgcttaagcctgtgttccagtggattggtgacaaagtgcaggcgctgtggggctggtttactgatctgctgacgcccgttacgtcgacctctgccgaactgcagagcgcagcggcaatggggcgacaattcggggaggcactggcggaagggctgaataaggttatgcatccgctggactccctgaaatccggcgtttcctggttgctggagaaacttggcattgtcagtaaagaggccgcaaaggcaaaactgccggaaagcgtgacgcgtcagcaacctgcgacggtgaatgcagacggtaaagtgatgatgccatcgggtggttttccgtcatggggatatggctttgcggggatgtatgacagcggcgggtatatcccgcgcgggcagtttggcatcgtcggtgaaaacgggccggaaattgttaacggcccggcaaatgtgaccagccggagaaatacagctgcactggctgccgttgttgccggaatgatgggcgttgctgccgcgccagcagagcttccaccgttgcaccctttggcacttcccgcgaaaggtggagaagcaattgtgagtcgcgcagccactgtgccgcccgttcaacggattgaggcaccgacgcagatcatcattcagacgcagccaggacaaagtgcgcaggatattgcgcgggaggtggcacgccagcttgatgaacgtgaacgcaggctgaaggcaaaagccaggagtaactacagcgatcaggggggatacgacgcatgatgatggtgctgggattgtacgtgtttatgctgcgcaccgttccgtatcaggaactgcagtatcaacgcagctggcgacatgcggcaaacagccgggtaaatcgtcgtccgtccacgcagtttctgggaccggacaacgacatgctgacgctttccggtgttcttatgccggagataacaggcggcaggctgtcgttgctggcactggagcagatggcagaacaggggaaagcatggcccctgattgaaggcagcggcacgatttacggcatgtatgtgattgagggactgaatcagactaaaacggagtttttccgcgacggtatgccgcgccggattgagttcaccctgtcgctcaaacgcgtggatgaatccctgtccgatatgttcggtgatctcagtgcgcaactgaataatcttcaggacacggcaacatctgtcttaagcgatatcagtaaaacggtgggagggctgctgtcgtgaatttcagctctgaactgcttaacaaaggcaacaaaactcccgcattcagcatcagtattgagggcagggatatcaccacagtgctggacaaccgcctgatggggctgacgctgacggataaccggggctttgaagcagaccagcttgatctggagctggacgacgccgacggaaaaatcgtgctgccgcgtcgtggtgcggtcgttacgctggcgctgggttggaaggggcagccgcttttcccgaaaggggcattcacggtggacgagattgaacacactggcgcaccggaccgcctgactatccgggcgcgaagtgctgattttcgggaaacgctgaatacccgccgtgaaaaatcgtggcataagaccaccgtcggggaagtggtgaaggaaatagcctcgcggcacaagctgaagatggcactgggtaaagacctgtcggataagctcgtagagcatatagaccagactaatgagagtgacggcagttttctgatgcggctggcgcgccagtacggtgccatcgcgtcggtgaaaaatggcaatctgttattcatccggcagggacagggcaaaagcgccactggtaaaccactgccggtgatcactatcacacgcaaggacggcgacagtcaccgctttaccctggcagatcgcggagcctacacgggggtaattgccagctggttgcatacccgcgaacccgcgaagaaagaaagcactacggtgaagcgtaagcgcaggactaagaagcagaagaaagagccggaagcgaagcagggcgattacctggtggggacggatgaaaacgtgctggtacttaatcgcacttatgccaaccggagcaacgctgaacgggcagcgaaaatgcagtgggaacgcctgcaacgtggcgttgcgtcattctcgctacaactggcggaagggcgggcagatctctacacggaaatgccagtgaaagtcagtggctttaaacagccgatagatgatgcggaatggaccattacgactctgacgcataccgtaagcccggataatggttttacgaccagtctggagcttgaagtgaggattgatgatttcgaaatggaatgattcttcgcaatggagaacttttaagtttgcaaaatggaataatgcggtatcattattgtgaatttagcaaaaatggggagaactcgaaaaatgatgatttgcccactgtgtggaagtgccgcccatactcgcagcagttttcaggtatcttcattgaccaaagagcgttacaaccagtgccagaacattaactgcagccatacttttgttacccatgaaacttttgttcgttcgattgcaacgccaaaagagtcaaatccggttcagccgcatccaatgaaatcaggacaggtggcgctctctctttgacgctgccgccattttgtcgccatcgttaaaaaatagtgtttctaacatcatgattttaaacagcttaaatttcaggcaacaaaaaacccatcaaccttgaaccgaaatggcggggttgatgggctccacaaaatggggacatcaaagaaaagcagtggcactaattaagactgatgccctgcggaaaagttctgcggttgtgcaaaaaaatttcattttcagggcaacttcagttttatcctaatcctggccataccatgacgatgattgtccctgccagcgtcagcaggacgttggcgattgcataggtgcccgcatagcccagcgccgggatgttactgcgagctgtatcactgatgatctccattgccggcgcgcaggtacgtgcgcccatcattgcgccgaacaacagcgcgcggttcattcgcaatacataagcaccgaacaagaaacagataaccacgggcaccagactgacaatcaatccggcaatcaacatctgaccgccaatcgcgcccaggccgttattaataccgctaccggcgctcagaccaacgcctgccataaacaccatcaagccgaactctttcaccatgcttaatgcaccctgcggaatgtaaccgaaggtcgggtggttagcacgcataaagcccagcataattccggcgaataacaacccggcagcgttccccatgccgaaactgaatgtgctgaactggaaggtgatcatcccgatcatcagcccaataacaaagaaggcgcaaaatgccagcaggtcagtgacctggctgtgaatcgagataaagccgatgcgatcggcgatggtttttacgcgacgggcatcaccgctgacttgtaaaacgtcacctttgttaagcacgacgttgtcatctatcggcatctcaatctggctacgaatgacgcggttaaggaagcaaccgtgatcggtcaacttcagttgtgcgagacgtttacctacagcgttatggtttttaacgaccacttcttcagtgacgatacgcatgtcgagaaggtcacgatcgaaaacttctttaccgttacggaagctgggatcgagtcgggcatgggcgtcgggatagcctaccaacgctatttcatcgcccatttgtagcacggcatcaccgtctggatttgccagaatcccgttacgtcgaatacgttcaatgtagcagccggtttgtcgataaatacccagttcacgcagatttttgccgtcggtccaggccaccagctccgggccgacgcgataggcgcggatcaccggtaaataaaccttacggttggcatcagtgtccaggccacgttcgcgggcgatttgctgggcgctggtctgtaagtcctgatgctgcaatttcggcaagtaacgcgcaccaacaatcaaactcaccagaccgattaaataggttaaggcatacccgaggctcagattatccagtgccagtgagagctgcctgctttccatgccggaatgacgcagtgtatcgccagcaccgaccagaaccggtgtcgacgtcatagagcctgctaacataccggccgtcaggccaatatcccagccaaacagcttacctaaccctaaggcgatcaccagcgcactgccaaccatcaccagtgctaacattaggtaatttttcccatcgcgaaaaaaaatggaaaaaaagttcggtccggcttcaaccccaacacagaaaataaacagcataaagccaagattaagcgcatcggtgttaatgctgaaatgttgttggcctaataacagcgatacgactaaaacgccaatggaattacccagttggatcgaaccaagtcgtaactttccgagacatagcccaagcgcgaggaccacaaataataacagaatgtaattcccatttaacaattcggcgacgtttatattcacggaggctaacttcttgtttactagtaagctgttgaaagaaatggtaatttacgataatgttttttaccagaattcagggcgcagattcattcagcgcacctaaacgatagtaaagtaacaatatattttactagtgtaatcacattaggtatcaacggctatatgaattgcgttggcctatattagcatggaatgcgaagcggctttatcttactgaacgccacactggcgaaaaatgtgttcgatagacgcagtgtcaggaggaacgagtgaaacataaacaacgttgggcgggggcaatctgctgttttgtcctcttcattgtggtgtgcctttttctggcgacgcacatgaaaggcgcttttcgggctgccgggcatcctgaaatcggcttgctatttttcattcttcctggagcagtcgccagcttcttttcacagcgtagagaagtcctgaaacctctgtttggcgcaatgctggcggcaccctgttcgatgctcattatgcggctgtttttttcaccgacgcgctcattctggcaagagctggcatggttattaagtgcggtgttctggtgtgcgctgggggcactgtgtttcttatttatcagtagtttgtttaaaccacagcacagaaaaaatcagtaaagccctcaacgcgagggcttgtcagacgatcaggcgtccagattttctttcacccatgcagcaaaatcggtatagccgccgatatgttgctgatcgacaaaaatctgcggcacggtttctacgggtttacctgccttttgttgtagatcttctttagtgatcccttccgcacgaatatctacatagtgatactgaaaatcatcgtgttcattgctcaatttctcagccagatcttttgcacgcacacagtaagggcaacccggacgaccaaaaataacggtttgcattatttctctcctcatagatttatgcctgtaatgatcacgctaaaatgtattcgctgaaagtaggtttaacctgttgcattaattgctaaaagctataactgttaaacacaatacagtgaaaagttttagactgaaggctcactttgcagagggaagcgtatgcgcgcgatcggtaaattgcctaaaggcgtgttgatactggaatttatcggaatgatgctactggcggtggcgctgctgtcggtaagtgactccctgtcgctgcctgagccattttctcggccagaagtgcagattctgatgatttttctcggtgttttgctcatgcttcccgctgcggtggtggttattcttcaggtggcaaaacgtcttgccccacagctgatgaaccgtccaccgcaatattcacgttcagaaagagaaaaagataatgacgccaaccattgaacttatttgtggccatcgctccattcgccatttcactgatgaacccatttccgaagcgcagcgtgaggcgattattaacagcgcccgtgcgacgtccagttccagttttttgcagtgcagtagcattattcgcattaccgacaaagcgttacgtgaagaactggtgacgctgaccggcgggcaaaaacacgtagcgcaagcggcggagttctgggtgttctgtgccgactttaaccgccatttacagatctgtccggatgctcagctcggcctggcggaacaactgttgctcggtgtcgttgatacggcaatgatggcgcagaatgcattaatcgcagcggaatcgctgggattgggcggcgtatatatcggcggcctgcgcaataatattgaagcggtgacgaaactgctgaaattaccgcagcatgttctgccgctgtttgggctgtgccttggctggcctgcggataatccggatcttaagccgcgtttaccgtcctccattttggtgcatgaaaacagctatcaaccgctggataaagacgcactggcgcagtatgacgaacaactggctgaatattacctcacccgtggcagcaataatcgccgggatacctggagcgatcatatccgccgaacaatcattaaagaaagccgcccatttattctggattatttgcacaaacagggttgggcgacgcgctaaaaccgccacgtcgatgtatgatacgcgggcttttgaccaggtctgacagagaggtgcagggtgaaaattgccatattgtcccgggatggaacgctctattcgtgtaagcggctgcgtgaagccgctatacagcgcggtcacctggttgaaattcttgatccgctttcttgctacatgaacataaatcctgcggcgtcttctattcactacaaaggccgcaagttaccccattttgacgcagtgatcccgcgtattggcaccgccattaccttttatgggacggcggcactgcgccagttcgagatgctggggagctatccgctcaatgagtcggtcgccattgcccgggcgcgtgacaaattgcgttccatgcaactgctggcgcgtcagggcatcgacctgcctgtcacgggcattgcgcattcgccggatgataccagcgatttaatcgacatggtcggtggtgcgccgctggtggtcaagttggttgaaggcacgcagggaattggcgtcgtgctggcggagacgcgtcaggcggcggaaagcgtgattgacgctttccgcggtctgaacgcgcatattctggtgcaggaatatatcaaagaggcgcaagggtgcgatatccgctgtctggttgttggcgatgaagtggtcgctgcgattgaacggcgggcgaaagagggcgattttcgttccaatttgcatcgtggcggcgcggcaagcgtcgccagtatcacaccacaggagcgtgaaatcgcgataaaagccgcgcgaacgatggcgctggacgttgctggtgtggatattctgcgtgctaatcgcgggccgttggtgatggaagtgaatgcgtcgccggggctggaaggaatagaaaaaaccactggtatcgacatcgcgggtaaaatgatccgctggatcgaacgccacgctacgacagaatattgcctgaaaacgggtggttagtcgcaatcacattactgatcatggttttgcctgcgctttttgcgtaagctgtgccggtctttttatcgaaagaggttgtacaaaattatgacatcgctggtcgttcctggtctggatacgctgcgtcaatggctcgatgacctggggatgagtttttttgaatgtgataactgtcaggctctgcatctgccccatatgcagaatttcgacggtgtctttgatgccaaaatcgatctgatcgataacacgatcctgttttctgccatggcggaagtccgaccttcagccgtattgccgctggcggcggatttatctgccatcaatgccagttcgctgaccgtgaaagcatttcttgatatgcaggatgataatctgccaaagctggtggtttgccagtctttatccgttatgcagggcgtaacctatgagcagtttgcatggttcgtgcgtcagagcgaagagcagatttcgatggtcattcttgaagctaatgcccatcaactgctgttaccgactgacgatgaagggcaaaacaacgttaccgaaaactatttcctccactgataactcctttcgagcacgcagtcgctggtgcagtggctgcgcgctgcaaaattatctgctgtttttaaccttttcttaaagattatttcacttctcttgtgtcgatttggctttatcacatagagcaaatacgcataaaaatttgttaaataccgttttttaatccgagctatagtctcaaaccctggctaaagttattcttgcgatgcttttatatagcgagcagtgctggccgggagagagttctcttttcttacaccgcgccgataaaaaatatgcacgtttattgcatatctttcagcatgacaacttttgttcgtttgttaacgaactttcagaaggaaagagatatgaccgccttaaataaaaaatggctttcgggtctggttgcgggtgctctgatggccgtctctgtcggcacgctcgcggctgaacaaaaaacactccacatttataactggtctgattatatcgcccccgacacggtggctaactttgaaaaagaaaccggtattaaagtcgtctacgatgttttcgactctaacgaagtactggaaggcaaattaatggccgggagcaccggctttgacctggtggtgccgtcagcaagctttcttgaacgccagctgacagcgggagttttccagccgctggataaaagcaaattgccggagtggaagaatctcgacccggaactgctgaagttggtcgccaaacacgatcccgacaataaatttgctatgccctatatgtgggcgacgaccgggattggctataacgtcgataaagtcaaagcggtgctgggcgaaaacgcgcccgtcgatagctgggacttgatcctcaagcctgaaaatctggaaaaactgaaaagctgcggtgtctctttcctcgatgcgccagaagaagtttttgctaccgtgctgaattatctcggcaaagatcccaacagcactaaagcggatgattacaccggacctgctaccgatctgctgttaaagctgcgcccgaacattcgttatttccattcatctcaatatattaatgacctggcgaatggtgacatctgcgtggcgattggttgggcaggtgatgtctggcaggcgtcaaaccgcgcgaaggaagcgaagaatggcgtgaatgtctcgttctcgattccaaaagaaggggcgatggcgttctttgatgtattcgccatgcctgccgatgccaaaaataaagacgaagcctatcagttcctgaattacctgctgcgtccggatgtggtggcacatatctctgaccatgtgttctatgctaacgccaataaagcagccacgccgctggtgagtgcggaagttcgtgataacccgggtatttatccgcctgcggatgtccgtgcgaagctgttcactctgaaagtgcaggacccgaaaatcgaccgtgtgcgcacccgcgcgtggaccaaagtgaagagcggaaaataatccgcagtcgtagatgccggacgggtgcaccacacacgccggcaattcgcaccatcatggtgcgcttgcacacattcaatgccggagagcagccgtgaatgacgctatccctcgcccgcaggcgaaaacccgtaaggcgctgacgccgctattagaaatccgcaacctcaccaaatcctacgatggtcaacatgcggtggatgatgtcagcctgactatctacaaaggtgaaatcttcgcgctgctgggcgcatccggctgtggcaagtccacgctgctgcgtatgctggcaggtttcgaacaaccttctgccggacagataatgcttgatggcgtcgatttgtcacaggttccgccttacctgcgccccatcaatatgatgtttcagtcttacgcgctgtttccgcatatgaccgtggaacagaacatcgcttttggcctgaaacaggacaaactaccgaaagcggaaattgccagtcgggtcaatgagatgctcggcctggtgcacatgcaggagttcgccaaacgcaaaccgcatcagctttccggtggtcagcgacagcgtgtggccctggcccgaagccttgccaaacgcccgaaactattactgctcgatgagccgatgggcgcgctggataaaaagctgcgtgaccggatgcagcttgaagtggtggatattctggagcgcgtcggtgtgacttgtgtgatggtcacccacgatcaggaagaggcgatgaccatggcggggcgtatcgccattatgaatcgcgggaaatttgtccagattggcgagccggaagagatctacgagcatccaactacccgctacagcgctgaatttatcggttcggttaatgtctttgaaggtgtactcaaagagcgtcaggaagatggcttggtgcttgattcgccggggctggtgcatccactgaaagtcgatgcggatgcttcagtggtcgataacgtgccggtacacgtagcgctgcgcccggaaaaaatcatgctttgcgaagagccgcccgccaatggttgtaacttcgcggtgggggaggtgatacacattgcctatctcggcgatctttcggtgtatcacgttcgactgaaaagtgggcagatgatcagcgcccagctacaaaacgcccatcgtcatcgtaaagggttaccgacctggggcgacgaagtgcgtttgtgctgggaagtggacagctgtgtggtgctgacggtttaaggagcaaagatgagtacacttgaacctgctgcccagtcgaaaccgccgggcggatttaagctgtggttgtcgcagctgcaaatgaagcatgggcgcaaactggtcattgcgttgccatatatctggttgatcttgctgtttctgctgccatttctgattgtctttaaaataagcctgggagagatggcgcgcgctattccaccttataccgagctgatggagtgggctgacgggcaactttccatcactcttaatctcggtaattttctgcaactgaccgacgatccgctctattttgatgcttatctccagtcgttacaggtggcggcgatttcgactatttgctgtttactgatcggctatccgctggcgtgggcggtggcgcacagtaagccttcgacccgtaatattttattactactggtgatcctgccgtcgtggacctcgtttctgatccgcgtttatgcctggatgggaatattaaaaaacaacggtgtgctgaataattttctgctgtggctgggggttatcgatcaaccgctgaccattctgcataccaatctggccgtttatatcggcattgtttacgcttacgtgccgtttatggtactgccgatttataccgcgttgattcgtattgattattcgctggtggaagcagcgctggatctcggtgcacgaccgctgaaaacgttctttactgtgatcgtgccgctgactaaaggtgggattattgccggatcgatgctggtgtttatcccggctgtgggcgagtttgtgatcccggaactgctcggtggcccggacagcatcatgatcgggcgcgtgctgtggcaggagttctttaacaaccgcgactggccggtggcctcggcggtagcgatcatcatgttgctgctgctaattgtgccgataatgtggtttcacaaacaccagcaaaaaagcgtgggagaacacggatgaataatttaccggtagttcgttcgccctggcggattgtgattttgctgttgggcttcacctttctctacgcgccaatgctgatgctggtgatctattcattcaacagctcgaaactggtgacggtgtgggccggctggtcaacgcgctggtatggtgagttattgcgcgatgacgcgatgatgagtgcggttggtttaagcctgacaattgctgcctgtgcggcaacggcggcggcgatcctcgggactattgcggcggtggtgctggtgcgctttggcaggtttcgcggatcaaatggctttgcctttatgatcaccgcgccgctggtgatgccagatgtcatcacgggcttgtcgctgttgttgttattcgtcgcgcttgctcatgccattggctggcctgcggaccgcgggatgcttaccatctggctggcgcatgtcacgttctgtacggcttatgtggcagtcgttatttcgtcgcgtctgcgggaactggatagctcgatagaagaagcagcgatggatctcggtgcgacgccgctgaaagtatttttcgtcattacgctaccgatgatcatgcccgcgatcatttctggctggttactggcttttactttgtcgcttgatgatctggtgatcgccagctttgtttctgggccgggagccaccacgttaccgatgctggtcttttccagcgtgcggatgggggtgaatccggaaatcaacgcccttgcaacgttaattctcggtgcggtcggaattgtcggatttatcgcctggtatctgatggctcgcgcagaaaaacagcggatacgcgatatccagcgtgcaagacgtggctgaagacactaaaatttgccaacctggctacataatgccgcgcatgccgcggcattgttttcatggaagacgaaacgttgggattttttaagaaaacatcttcatctcatgctcgcctgaatgtgcctgcgctggtgcaggtagcggcgctcgccattattatgatccgtggcctcgacgtgctgatgattttcaatacgctgggcgtgcgcggtattggcgagttcattcatcgcagcgtacaaacctggagcttaacgctggtctttttaagcagtctggtgctggtttttatcgagatctggtgtgcgttttcactggtgaaagggcgtcgctgggcgcgctggctatatctgctgacacaaatcaccgccgcaagttacttgtgggcggcttcgctggggtatggttatccggagctgttcagcattcccggtgaatcaaaacgtgaaatcttccatagcctgatgctgcagaagctgccggatatgctcatcctgatgctgctgttcgttccctcgaccagtcggcggttcttccagttgcaataatgtgtataatcgtcgcccctgatgatgtgaaggtcaatgtatgcagtgcgcactttacgacgcgggtcgctgtcgttcctgtcagtggataacgcagccgattccagagcaactctccgctaaaaccgccgatcttaaaaatctgctcgccgactttccggttgaggaatggtgcgcgccggtgtcaggcccggaacaagggtttcgtaataaagccaaaatggtggtgagtggtagcgttgaaaaaccactgctcggtatgctgcatcgagacggcacaccggaagacctttgtgactgcccgctttatcctgcctcatttgcgcccgtttttgcggcgctaaaaccgtttatcgcccgagcggggttaacgccctacaacgtggcgcgtaagcgtggcgaactgaaatacattttgctgactgaaagccagagcgatggcggcatgatgctgcgttttgtgttgcgttccgaaaccaaactggcgcaactgcgtaaggcgctaccgtggttacaggaacaactaccgcagctaaaagttattaccgtcaatattcagccggtacatatggcgattatggaaggggagacggagatctacctgaccgaacaacaggcactggcggagcgttttaacgatgtgccgctgtgggtccgtccgcaaagtttcttccagactaatccggcggtcgccagccagctgtacgctaccgcgcgcgactgggtacgacagctgccggttaaacatatgtgggatctgttctgtggcgtggggggctttggtttacactgcgcgacgcctgacatgcagttaaccgggatcgaaattgcgccagaggccattgcctgtgcaaagcagtcagccgctgaactgggcttaacgcgtttgcaatttcaggcgctggactccactcagtttgccactgctcagggggaggtgccggagctggtgctggttaacccgccgcgccgcggcattggtaaaccgctgtgtgattatctctcaacgatggcaccgcgttttatcatctactccagctgtaacgcccaaaccatggcgaaagatgtccgagaactgcctggttaccgcatcgaacgggtacagctttttgatatgttcccgcacaccgcgcactatgaagtgctgacgctgctggtgaagcaataaaaaagccgcaggtgcggcttcagattgctgacaaagtgcgcgttgtttatgccggatgcggcgtaaacgccttatccggcctacaaaagcgtgcaaattcaatacattgcatgggccatgtaggcctgataagcgtagcgcatcaggcaattttacctttgtcatcagtctcaagccgcggttgcggctttctgaatcttactgcgggaaccactggtcattgattttctgatatgtaccgtcagctttaattgctgccagcgcgttattcagtttttccagcagagctttgttatccggacgtacagcgatgcccagaccggtgccgaagtattgcggatcggtcactttttcagtagcaacgcccagttgcggattggttttcagccattcgtttaccaccgctgtgtcaccaaataccccatcaatacgaccatttttcagatcgataaaggcattctgataactgtcataggagacagttttcacttcggggtgctgatcctgaatatatttctggtgcgtggtgccgttttccatcccaatacgtttgcctttcagatcggcaaacgttttgtaggtatcttttttggcaatcacgacggctgagttttcatagtagggcgtggtaaacgatacctgcttgctacgctcgggcgtgatatccataccggagattacggcgtcatattttctgaatttcagtgacgggatcaggctgtcgaacgcgtgattagtaaaagtacattctgcctgcatttgtttgcacaaggcttttgccagatcgatatcaaagccgacaatctcattattagcacctatagattcaaaggggggataggtggctgaaacgccaaaattgattttctctgcggcagaagcaccgaaagtaaaggaagcaagtaaagcggcaagaactaactttttcatgatggaactcccgtctgtcaatcttatgatttttggccgtgtctgcggcatgggataacaatgccatcaagtgaatttatatgcaataaatatgattaaataatttaaatgaaataaaaaaagacggataacttagtgagttgtccgtcttcattataagaatttatgcactgtgtaggccggataaggcgttcacgccgcatccggcatcagcatgcagctacattaattccgccgttcgaatgccagtgctttgcgctcgatcagacgcatcatcagcgtcagcaggccgttgacgaccaggtaaataatccctgccgcaccgaacaccattacatcgtaggtgcgtccgtacaacaactggctgtatcccatcacttccatcagcgtaatggtgtaagccagagaggtacttttgaacaccagcaccacttcgttggaataagaagagagcgagcgtttaaaggcatacggcagcaggatcgccagcgtatcttttttgctcattcccagggcgctacaggactgccactgaccttctgggatcgcacgaattgcaccgtaaaacagctgcgtggtatacgccgcactgttcagcgataacgcaatcagcgcacataaccacggttctgacaacaaatgccacagtgccggatactcctgcaaagtcggaaactggcccggcccgtaataaatcaggaagatctgcaccagcagcggcgtaccggtaaacagcgtgatataaccccgcaccagccacaccagcaccggcgttttcagcgtcaggatgatggtaaaaatcaatgccagaatcagtgccacaatcagcgaggcaacggttagcgtcaggctggtgtgtagccctttcatcagttcgggtaaatactcaaacattagctgggcctccgctcaaaacgtgtcgcgcgcaggtcaatgcgtttgagaatgtactgactgagcagggtgatcaccaggtaaatcgccgccgccacaatgtaccaggtaaatggttcctgggtacgagtagcgatgctttttgtttgcagcattaaatcattcacactaatcaaactgaccagcgcggtatctttcagcagcaccagccactggttaccgaggccaggcagcgcatgacgccacatctgcggcatcaccagacggaaaaagatagccgatttcgacagccccagcgcctgaccagactcccactgacccaccggcaccgctttcaacgcgccccgaagcgtttgcgaggcataggcggcatacagcagtgacagagcgatgacaccacaaaggaacgggctaacgtcgaagttctcaatgtccatctgcactgggatctgcacgaacccaagattgatagtgaagccatccgaaagcgtcagcagcagctgcgaggagccaaaatagataaacagcaccaccagaatttctggcaggccacgcagaatggttaccagcgctgaacctgcccacgcgacaggacgccattttgccgactcccataccgcaaagaacatcgccagcgccagcccgacaatcaatgcacaaacggcaaggccgacggtcatcccggcggcgcttgctaaaggaaaaaattcattcatcaggaattacttctggaaccatttgttgtagatggtttcgtaagtgccatctttcttcactttttccagcgcagtgttgagtttctgctgcagctcagtgttgccctgacgtaccgcgatgccgaggccagtgccgaagtaatctttatcggtcactttgtcgcccaccgccgccagtttcgggttatctttcagccactcagtgaccactgcggtgtcaccgaagacgccgtcgatacgcccgttttgcagatccagttttgcgttctggtagctgtcatacggaacggtagtgatttccgggtgcttatccataatgaatttctggtgtgtcgtcccgttctgtacgccgacttttttgcctttcagctgatcaacactggtgtatttgccttgctgacccacaaacagggcagagttgtcatagtacggggtggtaaacagcacctgcttttcacgctccggagtgatatccatgcccgccatcacggcttctacgcgacggaatttcaggcttgggatcaggctgtcaaacgcctggttagagaaagtgcaggttgcatcaatctctttacacagcgcttgtgccaggtcgacgtcaaaaccaacgatctggttgtttgcatcaatcgattcaaacggaggataggaggcttcggtagcaaaacgaatggtttcggcagctgtggcggaaagactaaaacctgcaattaacgcggcaatcagaacttttttcattgttgttatcccgaatcttagtgagagagatagtttttaaatgcttcggtttgcggctcggtaaagcagctcgcgtcgccttgttctacgatatgaccattttccatatacaccactcggctggcggttttacgcgccacttcaacttcgtgggtgacgatcacctgggtaatattcgtttctgccagctcacgaatgatgctgacgatttgtgccgtaatttccgggtccagtgcggcggtcggttcatcgaacagcagtacctgcggttccatcatcaacgcacgggcaatagcaacacgctgctgctgaccaccagaaagatgcagcgggtaacgatcgctataaggtttgagacgcagacgttccagcagtttttctgcacgggccagcgcctgatctttactcaaccccagtacacggcagggcgcttcaatcaggttttgctgcacggtcagatgcggccacaggttgtattgctgaaacaccatgccaacgttacgacgcaaatcgcgaatcgctttgtcagagggtgttttggtgaaatcgaaatggttgcctgcaatgttgagcgtaccggagcgcggcatctcaagcagattgagtacacgcagcagcgagcttttacccgcgccgctggggccaagtaacaccagcgtttcgccctgtgggcaatccagcgtgatatcgaacagcgcctgatgcgcgccgtagaagcaattaatgccgtttaattgaatactcattgacactcgtatactggcagtctgatagctattgaggtcgaagatagtacctttgacagaataattatgcaatatttctgctttaaaagttaaaagcaaagcgcattattcaataaacatagcacaaaataacgggggcggtggtcggcgagcataaatgtcggcattcctcacgaaatgccggacaatttacggggtttattggttgatcaaggcgttagcgattctcgatggactgacggagcgtacccgccgtggcatgaacgctaccgcctaagtaacgcacatcgtcgatgacccaacactggccttcctgaatcattaacacttcatcctgccagccctggtcaccctgtttaagatccacgcgcaaaggaatgttacgggcatcacgattagggatagtcgatgcactggcaacgtgggcgctgtctggcaaggtggttcgactggagaatggatcgttggtcagtagttcccgatggttattatcccgggaggcatcgctaagcagtgtcgccagtttgtcgctcagataagggcgcaaggcggtgatgtcgttgctgcggtgcaaaatgcggtagtcataaaattgctgggccacgttatccgggcctccttcaacgcaaggaccactgcgtgtgccgttatctttataagctggagtgactgtggtgcaggcactgaggagcagtgcgcaggggataagcattgtcaatttgctgtagcgcataatgatttccttataagcgatcgctctgaaagcgttctacgataataatgatatcctttcaataatagcgtatcagtctgataatgcttttgagatcgaaggcttagcaaacaaggagatcgatcatgcaattttctacaaccccaactctggaaggccagaccatcgttgaatattgcggtgtggtgaccggcgaagcgattttaggtgccaatattttccgtgatttctttgccggtatccgcgatatcgttggcggacgttccggtgcgtatgaaaaagaactgcgtaaagcacgggagatcgcctttgaggaattaggctcccaggcgcgggcgctgggggccgatgccgtcgtcggtattgatatcgactacgaaacggtcgggcaaaacggcagtatgctgatggttagcgtcagcggtacggcggtgaaaacgcgtcgatgagaagagtcttctggctggtcgctgccgctctgttattggcagggtgtgcaggcgaaaaaggcattgtcgagaaagagggatatcagcttgatacccgacgccaggcgcaggcggcgtatccgcgcattaaagtgctggtgatccactacaccgcagatgattttgatagctcgctggcgacactgaccgataagcaggtcagctcgcattatctggtccctgcggtaccaccgcgatacaacggtaaaccgcgcatctggcaactggtgccggaacaagaactggcctggcatgcggggattagcgcctggcgcggggcaacgcgccttaacgacacctctattggcattgagctggaaaaccgtggctggcaaaaatcggccggagtgaaatattttgccccgtttgaaccggcacagattcaggcgcttattccactggcgaaagatattattgcccgttatcacatcaagccggaaaacgtagtggcacatgcggatatcgcaccgcagcgcaaagacgatccggggccattatttccctggcagcaactggcgcagcaggggattggtgcctggccggatgcgcagcgggttaacttttaccttgccgggcgcgcgccgcacacaccggtagataccgcgtcattgctggagcttttggcgcgctacggttatgacgttaaacctgatatgacaccgcgcgagcagcggcgcgtgattatggcattccagatgcatttccgcccgacgttatataacggcgaagcggatgcagaaactcaggcgattgccgaagcattgctggagaaatacgggcaggattagcgcggcagttttccgtggtcgcgtagccaggcggcagttttctcgataccttcatccagggtgatgaccggctgataacctaactcttcctgcgcacgcgtaatatccagcgtaaagtcaaaattcaacttggagacgccgtagtgggtcagcggcggctcttttgctgacttgcggcctaaacgctccatgctgcgggcgatcatatccagcatcgggtaggggacggaacgaatacgacagtcaatattcaactcgtcgatcagcttctgcacgatgctgcgcagtgtgcgatgctcgccgttggtgatgttgtacacacgcccggaaggtagcttatcgcaggcttcctggcttgccagccacattgcgtgcacggcattttcatagtaggtcatatcgaccagcgcactgccgccatgcggtaacagaatactgccgtagtggtgcatcatatgcgccagacggggaataaagactttatcgtgcggtccgaacagactttgtgggcgcagaatagtaaagcgcgtttgtggattcgcctgcgaaagcatattgatcacttcttcgctggctgctttgctgcgggcaaactcgttggcgaagcggtgagggcgaaaatcttctttaatatcgcgatggtggtgataatcgaagtacagggagggggaagagatatgaataaagttacgcacaccccaggcgacagcccattcacccaggcggcgagtggcgcgaacgttagccagatcgaaagcctgttgtgtcccccagggtgaggtaaagctggagcagtgccacagcgtatcaatgcccgcgagcatcactttagcttgtgatgaaaccagctcggtcagatccgccggaacaaactctgcgcccattttttccagcaatttgcccattgcctcgttgcgaccggtcgctcgcacgctgatgcctttctggcataaaaactctaccgcgtttcgacctaagccgctggtggcgccggtaaccagtaccttcatatcaatccactgttgttgagaaaatgacgtgcgcattcttccgtgatttcccccatgatgcaatgggaaacatgaaagaataacgcaggttttgtcgattaatctgtgctttgttctgccagtctggcgatttgttttgccattccgcgaaaaataaacagatgcgcggggatcatcaataaccagtaaaacagccccggcataccgtgcggatgccagaaagcgcggacatcaatagtacgatagtcacctttatcttccagggtaaaacacagtcgtcccagccccggcgctttcatgccaaataacaacgtaagttgctttttcggttcaacgacaatcactttccagctatccaccgcatcgccggtctgtaaatattcgcgctccgggcggcctttcgccagcttatgaccgatcgcgcggtccatcaacgcccgtgtctgccacaaaatattgccaaagaaataacgctctttaccgccgatttggttcaccacctgccataaagccgcaaggctggcggacgttttaacggtaaaccccgcctgtttggcgaaataaccgtactccggtcgccagcgggcaaaggcctgagcgtcgtagccccagtcgctggagttgaccagtttttcttcctctttcaacgtgctacgtaccgcgtcatcgaaagcgatcagccgttgtgggatgagtgcacgtagcgcggtatcatccgccagcagatcgtgtttcagcccctgaatcaacgccctggcggtggtgggcggtacggaagtaatcacattgagaaaccacaccgaaatccagcgggtggggagggggatggggatcaaccagcggcgcttaccgctcaccgccataaaatgttcaaactgttgctgataactgagcacctctggtccggcggcttcgaagatgcggtgttcgctggccggatgatctaacaacgccaccagatagtgcagcaagttttccagcgcgatgggcgtggtgcgtgaacgtacccagcgtggcggcgttaacactggcaggttgtagaccatatcgcgcatgacttcgaacgccgctgaacctgcgccaacgataattccggcccgaagttcggtcacaggtacattcgcttcacgaagaatgtccgccgtagcctgacgagcacgcagatgatccgactgctcatgtggcggggcctgcaacgaactgagaaagattaattgcttaactggtacttcacgtagcgcatcgcggacgttgagagccacctggcgctcctgagcgataaaatcgccgccttcgcccatgctgtgcaccagaaaatagacggtatcgatatcctgcaacagggccggaaggttatccggccagctgagatcgactttatggcaactgacgtttgccagttgcagctttgcaagcctgtcgacatgacgtgccgccgccaggatctgatgcccttgctggctgagtgtgcgcaccagatgctgaccaatgtagccactggcaccgagaactaaaatgcgttgcggcacgtctctctccttaacgcgccaggaatgcgcgccagtgggcggcgacttccgccagttgttcgcgcgagacgtcaagatgcgtcaccaggcggacaatcggcgaggcgttaatcagcacgtttctcgctttcatgtattcgcctaacgcggcagcattttcttccccgacgcgaacaaacagcatattagtgtcctgacgcatcacatccgcgcctgcttcacgcagttgctccgccatccaggcggcgttgtcgtgatcttcctgcaaccgtgcgacgttatttttcagggcatacatcccggcggcagccagaatcccggactgacgcatcccgccaccggccattttccgccagcggatggcacgtttaatgtaatcacgattaccgacgagtaatgaaccgactggcgtcccaagacctttcgacaggcaaatggtgaacgaatcacaatattgcgtgatctctttcagttcgcagccgtaagccaccacggcattaaagatgcgcgcaccgtcaacatgcagcgccagattgcgctcgcgggtaaattcccatgcttctttcaagtattcacgcggcagcactttgccgttgtgggtgttttccagactgagtaatttggtgcgggcgaaatggatatcgtcgggtttgattttcatcgccactttatccagcggtagcgtgccgtcggcagccgcgtcgatgggttgcggctgaatactgcccagcaccgctgcgccaccggcttcaaacagatagttatgcgcggcctgaccgacaatatactcttcgccacgttcgcagtgactgagcagagcgaccaggttggcctgagtgccggtaggcagaaaaatggcggcttctttaccggaaagctctgctgcatagtcctgcagagcattaacggtagggtcgtctccgtaaacgtcgtccccaaccggggcggccatcatcgcttcgagcatggcgcggctcggtcgggtaacggtatcactgcgtaaatcaatcatggcatgtccttattatgacgggaaatgccaccctttttaccttagccagttcgttttcgccagttcgatcacttcatcgccgcgtccgctgatgattgcgcgcaacatatacaagctaaatcctttggcctgttcgagtttgatctgcggtggaatggctaactcttctttggcgaccaccacatccaccagcaccggaccgtcgatggagaaggcgcgttgcagggcttcatcaacttcagacgctttttctacacggatacccgtaatgccgcacgcttcggcaatgcgggcaaagtttgtgtcgtgtagttcggtgccgtcagtcaaatagccaccagctttcatctccatcgccacaaagcccagcacgctgttgttaaagacgacaattttcactggcagtttcatctgcactactgagaggaaatcgcccatcaacatgctaaaaccgccatcgccgcacatggcgaccacctgacgttctggctctgtcgcctgcgcacccagcgcctgcggcatggcgttagccatcgaaccgtggttaaacgaacctaacaggcgacgcttgccgttcatttttagataacgcgctgcccatactgttggcgtgccgacgtcacaggtaaagattgcgtcatcggcggcaaaatgactaatttgctgcgccagatattgcgggtgaatggctttctcgctcggtttagctaaatcgtccagccctttgcgggcatcgcggtaatcttccagcgctttatccagaaatttgcgatcggctttttcttccaccagtggcagcaatgcacgcagggttgatttgatatcgccgaccagcgccatatctaccttgctatgcgcgccgatgctggctggattgatatcaatctgaatgattttggcatcggtcgggtagaaggcgcggtagggaaattgcgtgccgagcagcactaacgtatcggcattcatcatagtgtgaaaacctgacgagaagccgattaacccggtcattccaacatcatacggattatcgtattcgacatgttctttaccgcgcagggcatgaacaataggtgctttaattttcccggcaaactcaactaactctttatgcgcccccgcgcagccgctgccacacatcagggcgatattgctggaataacgcagcagttgcgccagtttgcgtaactcttcttcttccggcgtcacaactggctgtggcgcatgataccagtgggtagttgctccttctggcgcaggttttaacgccacgtcacccggtaacacaacaacggaaacgccacggttaagcactgctttgcgcatagcaattgccagcacttgtgggatctgctccgggctggaaaccagctcgcaatagtgactacattcgcggaatagctcttgtgggtgggtttcctggaaatagccgctgccaatttcgctggagggaatatgagcggcaatcgccagtaccggaacgtgattgcggtggcaatcgaacaggccgttgattaagtgcaggttgccggggccgcacgatccggcacagaccgccagttctccgctaagttgtgcttcagcgccagcggcaaaggccgccacttcttcgtggcgggtggacatccactcgatggtgcccatgcgattaagactgtcactaagaccgttcagagagtcgcctgtgactccccagatgcgtttcacccctgccgattcgagtgttttggcgatataagctgcaaccgtttgtttcatggttctccatctcctgaatgtgataacggtaacaagtttagttcatctgacggagggggaagggatgggagagaaaggaggcactaacggttaaatagcccgatgaaaggaatatcatcgggcataaggcgattatgcgagaaccaaatccccctgcggatggcaggagcaggccagtacgtaaccttcagcgatttcggcgtcggtcagcgtcattgtgctgctcaccgtatattcaccggaaaccacttttgtcttacagcagccgcaaacacccgcacggcaggcagcgacaaccggaacgttattgctttccagcgcctccagtagcgtggtgccaaccggggcgtaaaattctcgtgccggttgcagtttggtgaatttcagaccgctggtcgccgcttctgctactggggtgaagaatttctctttaaagaaacgcgtcacgccgagcgctttcacttcctgctctacccaatccatatacggagccgggccgcaggtcatcacggtacgtgaagctaagtcaggtacacctgccagcagttcgcgagtgagacgaccagcgataaagccttcggtaacgttattttctgccaccagtgttaccggatagttacgccactcatcggcgaaaataacatcctgcggcgtacgcacgttgtagatcacctgtacatcggcctgtggacagttcttcgccagccagcgacgcatcgacataatcggcgtgacgccgcagcctgccgccagcaacaggaatttatcttctgctttatcgtcgcaggtaaattcccccatcgcgtccgaaagccagagataatcaccgcgttttacatcgcgcgtcagccactgggagccgacaccgtcatcaatccgccgcacggtcagggtgatatattcactcacgcctggcgtggaggaaatggtgtaagcacgcagcgtttccgctgagtttcgcacgctgaccagtgcatattgcccggcgcgatatgggtagtaatcgtggcaaatcagggaaatcgtccacacatccggcgtttcttgcgtaatgtgatgaacctgcatccgccacgggcattgattcgttggcatcgtcatcgacaaactccttacgcgctcaacagttgcttcatgtcttcttcaacagtggtgatagaacgcaggccgaatttctcgttcagcaccgccagcaggtctggtgtcaggaaaccaggtgcagtcgggccggtgacgatatttttcacgcccagagaaagcagcgtcagcagaatgacgatcgctttctgttcaaaccaggagagcaccagcgacagcggcagatcgttcacaccacagcccagtttctctgccagagtgacagccagaataatcgctgagtaagcatcgttacattgacctgcatctaccagacgcggcagaccttcgatatcgccaaactcaagtttgttaaagcgatatttaccacaggcgagggtcaggatcaggcagtcatccggcacgctggtggcgaaatcggtgaagtagtggcgctcgccgcgtgcgccgtcacagccaccaagcaggaagatatgacgcagtttttcacggctcaccagatcaatcagcgtatcagcagcgccaagcagcgtctggcgaccaaaacccacggtgataaggtgcggaatttcgctgtacgggaagcctgccatctgttgcgcctgggtgataaccgcagagaaatcatcaccgtccagatgacgcacgccaggccagccaacaatgctgcgggtccagatacgatcgtcataagcgcctacggttgggtcgatgatgcagttcgaggtcatcacgatggggccagggaaacgagcgaactccacttgctgattctgccagccgctgccgtagttaccgaccagatgcttgaatttacgcagctccgggtagccatgcgcaggcagcatttcgccgtgggtgtagacattaacgcccgtgccttcggtctgttccagcaggttgtagagatctttgagatcgtgaccggaaatcaggatgcatttacccgccgtcgctttgacgttgacctgggttggcgtcgggtgaccgtatttaccggtttcgcctgcatccagaatgctcatcactttgaagttcatctggccgatttccattgaacactcaagaagcgcgttcatatcggcaggccaggtccccagccacgccatgattttatgatactgggcataaatatcgttgtcgtattgaccgagaacatgcgcgtgttccatataggccgccgcacctttcaggccatacaggcacagcagacgcaggccgagaatgttttcgccaatcgccgctttatctttgttaggggtaaattctgctgcctgacgttgcagctcgccgagatcgtcgctcaccagttgcaggtcagccatcgggttatcgacgcgcgcgttggcatctacagccaggcattgcgctttcagcgcctcgcgcagggcaatcgcttcacgagcgtagccgacaatacgcggagaatcgaagttaacgttggtcagggttgagaaaaaggcacgtggcgcgaagctgtcaacatcgtggttgatgatgccgtattcacgcgcttttaccgcccaggcagaaagcccttgcagcgccgcgatgagtaaatcctgaaggtcagaagtttccgccgttttaccacacatcccctgcgcgtatgagcagccgtttcctgccggagtacggatagtttgttcacattgcacacaaaacatgatcacaccttttaaagttatatttaatatacatgtttaaggttaagacgcttaacgcggggataaaagggatttttcatgcaactttaagggagattgatttagcgcaattttggcggcagggatctaccgccagagaggtattacgcagagaaaaaggcgatgaggatcggcactaacaggctaagaataaaaccgtgaacaattgccgccgggaccatatccagcccgccagtacgttgaagaacgggcagggtgaaatccattgatgtggcaccgcataagcccagtgcagtagagcggctgcggcgaatcagcccagggatcaacataatagcaatcagttcacgggccagatcattaaaaaacgccgcgctcccgattaccgggccaaaagattcggtcaataaaataccggaaagagaataccagccgaaaccggaggccattgccagcgcggtattgatggggagatcaagaataaaggcgttaattaaaccaccaattaatgaactggcaaccaccaccacggcgacaatcattccccggcgattaaggacaatctgctttaaggtcatgccattattgcgcaactgaataccgacgaggaaaagtagcagaattaacgtgtattcgctggcttcggtcgcgtgttgtaagaaagccagtccactcagaccaatggcaaaaccaatcactactacgccgcacagttttagcgactccagcgccatcgcaatacgcgacgggagtttttcttgctgatggtgattgcgccatggcaggcctcgctccagccacatcagggcggcaatattacatagtaaaataacggtaatactgacagcagaataatgcagaatcgccaacaggttactggcgaggttatcgagaaacgccagactgatacccataaaaaagagaataaggtaaaccatccagcttaatagctgattaataacttttaatgcagctttttggcgaagcggaatgaggtaacccacaatcaggggaaccagaatgattaacagcccagaaaacatgaaaacccagtccttgcaaagatgaagtcgaaatgcgcgatgacacactactgaaagcggaaggacgagtaaagttgcaattaaaaggaaatgttatgcataaggagcagtagagtattcgttttcatttaaagatattcttgcgctttaattacaaactgcaccgatgttggtggcgtcaaaatcgccgaggcgttccctgaaggccggggcagcccacatggatgtgggctgagggcgcgttttacagggatgttacctcgcgcccgacccggtagccgtaagggataagtcgagggcaccgcgcagcggcgattttgttcgccagagcccgggggtgcagggggcggcggcgattggccgccccctgcgcgctccttgcgccagtggcaatatgtggcttagctcatgaaaggagcgcaacaagatgatgaatcaacatataacaacatcttaaaaaaaggcctgacattacgccaggccttctgcgttaattaatcacgcttttccagcagggtccggtaaatcagaccaccgataatgccgccgacaattggcaccacccagaagaaccacagttgttctaatgcccagccgccctggaagatagcaaccgcggtgctgcgcgccgggttaacagaagtgttagtcaccggaatactgattaagtgaatcagggttaaggccagaccaatagcgatcggcgcaaaacctgccggagcgaatttgtcggttgcgccgtggatcaccaacaggaaacctgcactcaataccagttcaactaccagcgcggaaagcatggaataaccgcctggtgaatgctcgccataaccgttagaagcaaaaccgctggctgccgcgtcaaaacccgttttaccactggcaattaaatacagcagcgctgccgcaacaataccgccgacaacctgggcaattacgtagccaacgacttcttttgccggaaaacgtccgccagcccataaaccaatagtgaccgccgggttaaaatgaccaccagaaatatgaccaacagcaaaggccatcgtcagaacggtcagaccgaacgccaacgccacgccggcaaaaccaatgcctaattccgggaagcctgcggccagtacagcactaccacagccaccaaaaacaagccagaaagtactaaaacattcagctgctaattttctgaacatatccacctcaattaaaaattgaccctgtgaaaaatatggtcgttttatagggccgtcgtaaaaagtgacgacggaaataatgcgcggctattttaaaaacgaaggcgagtcattcaccagataaataaatccagtaaatttgatttagggcaacagcgggttgccccatatagtcgtttgtctgattgacagtgtagtgcaagcaaaagatttaatcctttaggcgtaataaaaaataatttatcatgctaattatttgattttgttgtttttgcagacttatcagcaagagggagtataacgcgattattcgctcatttttcagacatttgccatgcttaaatgtgatgtcatcacgtattagcaaggcctttcccgttatactgccagcgtaaaggataagtcacatatttctggaggggatatgattcttgagcgcgttgaaattgtgggttttcgcggtatcaaccgtttgtcgttgatgctggaacaaaacaacgtcctgattggggagaacgcgtggggtaaatccagcttgctggacgccttaactctgctgctatcgccagaatcagatctctaccattttgagcgcgacgatttctggttcccgccgggagatatcaacgggcgagaacatcatctgcatattattttgaccttccgcgaatcgctgccaggccgacatcgggttcgccgttatcggccgctggaagcgtgctggacgccatgcaccgatggctatcaccgtattttttatcgtctggaaggggagagtgcggaagacggcagcgtgatgacactgcgcagttttctcgataaagacggacatccgattgatgtcgaggatattaacgatcaggcacgccatctggtgcgtttaatgccggtgctgcgcttgcgtgatgcccgttttatgcgccgtattcgtaacggcacggtgccaaatgtccctaatgtggaagtcaccgcgcgccagctcgatttcctcgcccgtgagttatcctcacatccgcaaaatctctctgatgggcagattcgtcagggactttccgcaatggtacagctgcttgagcattatttctctgagcagggggccggacaggcgcgatatcgtttaatgcggcggcgagccagcaatgagcaacgaagctggcgctatctggatatcatcaaccggatgattgaccgacctggtgggcgctcgtatcgggttattttgctcggcctgtttgctactttgttgcaggcaaaaggcacattgcgactggataaagacgcccgtccattgttgctgatcgaagatccagaaacccgtttacaccccattatgctttcagttgcctggcatctgttgaatcttctgccattgcagcgcattgccaccaccaactcgggtgagttgctttcgttaacgccggtagagcatgtttgccgactggtacgtgagtcctcgcgcgttgccgcctggcgtctggggccgagtggcttgagtaccgaagatagccgacgcatatcctttcacattcgttttaaccgtccgtcatcgctgtttgcacgctgctggttgctggtggaaggggaaacggaaacctgggttatcaatgaactggcgcgtcagtgcggacatcattttgatgccgaagggatcaaggtcattgagtttgcccagtccgggctaaagccactggttaaatttgcccgccgaatggggattgaatggcatgtactggtcgatggcgatgaagcagggaagaaatatgccgctacggtacgcagcctgttgaataacgatcgggaagccgaacgagaacatttaacggcgttaccggcgctggatatggaacattttatgtatcgccagggattttccgatgtgttccaccgcatggcgcaaatcccggaaaatgtaccgatgaatctacgcaaaattatctcgaaagcgatccatcgctcttccaaacccgatcttgccattgaagtggcaatggaggcaggacgtcgtggtgtggactccgtaccgacgctgctgaaaaaaatgttctcacgcgtgctgtggctggcgcgcggtcgcgcggattaaccgcgaaacatcgtggccatttgtggctgaatagcgtcgagcatctcatagcgccgacggtattcagcccgttttttactggcgatttcggcaatctcttttcgtgctatctgtgctggaaggcggtaatggcgttcagcatcacatacgccgccaaccgattcccagaaagcgttgtaatcagcgtggatcttgccttctttatcgcgataacgcaggctgcggtaaatatgcgtttcattgctgacggcaataatctgctctacctgcaaacgttgggcaaacagacaggccgcttccatcacgaggcgtttgggaaatagcccgtggcaggctttcgtcgcattctggatttcctgatgtggaatttcccattttgcgccttgcagtccgccaataaacatcgttcttttcccctgatattcacacagggtaaacgtgatctctgccagaggaataccttcgctgttgcggaacaggattgtgctgtcaccttctttatccattgagatcatcatggtcagctcaagcgtgaactgctcgccgtttttgccttccagcttcgccagttgcagcccgggggtattcaaatataagctgaattcttccgccgacatacattcgcggagtaacgcataatggtaacgtaacgcctccagcaattgcttacggctaagattcgccgcaaggtaagggcgatgcagacgcacaggcagtcgcggctggcgcgttaacaatacattgagattaggccagtgggaaagttcgttcatccactcaacgcttaaacgcggcataatcaacgagcgcagcaaaaatttctggcgaaaactacggcgatgccagaatttacccggccgacactgtccacgtgccagactaagaaaaagtgacaggctgctgagagattcagatggcgtaaaggtccgttcagttagctgcgacatattcatgaaatcaatggttatacatgacgtcgatttcaccattgcgtatcttaaccaaacatcaatagtgtgattactaacgtaaattttaggggtttgttgatatttcgttgaagttaatgacccggattggcatatggagtattcagaatatttatgaaaaagcggaaaaccgtgaagaagcgttacgttattgcgctggtgatagtcatcgccggactgattacgttatggagaattcttaacgcacccgtgccgacttatcagacactgattgtgcgccccggtgatttacagcaaagcgtgctggcgaccggaaagctggacgcgctgcgtaaggttgacgtgggcgcgcaggtcagcggtcagttgaaaacgctgtcggtggcgattggcgataaagtaaaaaaagaccagcttttaggggtcattgatcctgaacaggctgaaaaccagatcaaggaggtcgaagcaacgctgatggagctacgcgcgcagcggcagcaggcggaagcggagctgaaactggcgcgggtgacgtattcccgtcagcaacgtctggcacaaacgcaggcggtttcacagcaggatctcgacaccgccgcgacggagatggctgtgaaacaggcgcaaattggcaccattgacgcgcaaatcaagcgcaatcaggcttctctcgatacggctaaaaccaatctcgattacactcgcatcgttgccccgatggccggggaagtcacgcaaatcaccactctgcaaggccagacggtgattgccgcacaacaagcaccgaacattctgacgctggcagatatgagcaccatgctggtaaaagcgcaggtttctgaagcggatgtaatccacctgaagccggggcaaaaagcctggtttacggtacttggcgatccactgacgcgctacgaggggcaaatcaaggatgtactaccgacgccggaaaaggttaacgacgctattttctattacgcccgttttgaagtccccaaccccaatggtttgctgcggctggatatgactgcgcaagtgcatattcagctcaccgatgtgaaaaatgtgctgacgatccctctgtcggcgttaggcgatccggttggcgataatcgttataaagtcaaattgttgcgtaatggtgaaacacgcgagcgtgaagtgacgattggcgcacgtaacgataccgatgttgagattgtcaaagggctggaagcgggcgatgaagtggtgattggtgaggccaaaccaggagctgcacaatgacgcctttgctcgaattaaaggatattcgtcgcagctatcctgccggtgatgagcaggttgaggtgttgaagggcatcaccctcgatatttatgctggtgagatggtggcgattgttggcgcttcgggttccggtaaatcgaccctgatgaatattctcggctgtctggataaggccaccagcggcacctatcgcgtcgccggtcaggatgttgccacgctggacgccgatgcgctggcgcaactgcgccgcgagcatttcggctttattttccagcgttaccatttgctttcgcatttaaccgccgagcagaacgttgaagttcccgccgtctatgctggtcttgagcggaaacagcggctgcttcgcgcccaggagttgctgcaacggctggggctggaagaccgtacagagtattatccggcacagctttcgggtggtcagcaacagcgcgtcagcatcgcgcgggcattgatgaacggcggtcaggtaattcttgccgatgaaccaaccggcgcactggacagccattctggcgaagaggtgatggcgatcctgcatcagctgcgcgatcgcgggcatacggtgattatcgtcacccacgatccgcaggtcgctgctcaggccgagcgggtgatcgaaattcgcgacggcgaaattgtgcgcaatcctcccgccattgaaaaagtgaatgttgctggcgggacggagcctgttgtcaacacggtgtctggctggcggcagtttgtcagcggttttaacgaggcgctgacgatggcatggcgggcgctggcagcgaataaaatgcgtactttactgaccatgctggggattattatcggtattgcgtcggtggtttccattgtcgtggtgggtgacgccgccaaacaaatggtgctggcggatattcgttctattggtacgaatactattgatgtctatcccgggaaagattttggcgatgacgatccgcaatatcaacaggcgctgaagtacgacgacttaatcgccatccaaaaacaaccgtgggtcgcctcagccacacctgccgtctcgcaaaacctgcgcctgcgttataacaatgttgatgttgctgccagtgccaatggcgtgagcggcgattattttaatgtctatggcatgaccttcagtgaagggaacacctttaatcaggagcagctgaacggtcgtgcgcaggtcgtggttctcgacagtaatactcgccgccagcttttcccccataaagcagatgtggttggcgaggtgattctggtcggcaatatgcccgccagagtcattggtgtggcggaagaaaaacagtcgatgtttggtagcagtaaagtgctgcgtgtctggctaccttacagcacgatgtccgggcgagttatgggccagtcgtggcttaactccattactgtcagggtgaaagaaggatttgacagcgccgaggcggaacagcaactcacgcgtttactttcactgcgccacggaaagaaggatttctttacctggaacatggacggcgtcttgaaaactgttgaaaagaccacacgtactttacaactgtttctgacgctggtggcggtgatttcgctggtggtgggcggtattggtgtaatgaatattatgctggtgtcagtgaccgagcggacgcgggaaattggcattcgcatggctgtaggtgcgcgagcaagcgatgttttgcaacagttcctgatcgaagccgtactggtttgcctggtcggtggcgcgttgggaataacactgtcactgttaattgctttcaccttgcagcttttcttacccggctgggagattggtttttcaccgttggcgctgctgctggcgtttctctgctcgacggtcaccgggattttatttggctggttacccgcacgaaatgcggcacgactggatccagtagatgctctggcacgagagtaatttttgagataaaaatgccagccgatcgggctggcattttgcctttaggatgtacacaatgagacagaagagctatgcgactgccgcttctacttcgacgggcacaataacactggcgtgattgccttttggcccctggtggacatcaaactgaacggattgtccagcttttagcgttctgtaaccatccatctgaatggtggaataatgagcgaaaatatcttcgccgccgccttcagggcagatgaaaccaaaccctttggcattgttgaaccacttaacagtacccttttccatgcttcgacatccttcgcaaatcttatacaagtaagatggaataaaccggggtcagagagggggctgttcaaaacctcgccaactctagaaatacaatttagagaattagggcgagccgtcaagcatttgacaggggacagggggcaggtatgaatcaaaaatttgaagcagttaacgctattgacaggaatgtgacagatgtcgctgatgccaacgatagatgatagttatctatcatgtggagtagattggtcaggcaaataagctcttgtcagcggcagggcgttctgccgataaccgtaaccgaagatgataactgacaatgggtaaaacgaacgactggctggactttgatcaactggcggaagaaaaagttcgcgacgcgctaaaaccgccatctatgtataaagtgatattagtcaatgatgattacactccgatggagtttgttattgacgtgttacaaaaattcttttcttatgatgtagaacgtgcaacgcaattgatgctcgctgttcactaccaggggaaggccatttgcggagtctttaccgccgaggttgcagaaaccaaagtggcgatggtgaacaagtacgcgagggagaatgagcatccattgctgtgtacgctagaaaaagcctgaatgcaggcataaaaattgggggaggtgcctatgctcaatcaagaactggaactcagtttaaatatggctttcgccagagcgcgcgagcaccgtcatgagtttatgaccgtcgagcacttgttactggcgctgctcagtaacccatctgcccgggaggcgctggaagcgtgttctgtggatttggttgcgctccgtcaggaactggaagcctttattgaacaaaccacacccgttctgcctgccagtgaagaggagcgcgacacacagccgacgctgagttttcagcgtgtactgcaacgtgcggtcttccatgtccagtcctccggtcgcaatgaggttaccggtgcaaacgttctggtcgctatctttagcgaacaggagtcgcaggcggcatatctgttgcgtaaacatgaagtcagccgtctcgatgtggtgaattttatctctcatggcacgcgtaaagacgagccgacacagtcttctgatcctggcagccagccaaacagcgaagaacaagctggtggggaggaacgtatggagaatttcacgacgaacctgaatcagcttgcgcgcgtgggcggaatcgacccactgattggtcgtgagaaggagcttgagcgtgctattcaggttctctgccgtcgccgtaaaaacaacccgctgctggtgggggaatctggtgtcggtaaaaccgcgattgcagaaggtcttgcctggcgaattgttcagggcgatgtgccggaagtgatggctgactgtacaatttactctctcgatatcggttctctgttagcgggcactaaatatcgcggcgactttgaaaaacgttttaaagcgttgctcaagcagctggagcaggacactaacagcatcctgtttattgatgagatccacaccattatcggtgcgggtgcagcgtctggtggccaggtcgatgcggctaacctgatcaaaccgttgctctccagcggtaaaattcgcgtaattggttcgacaacctatcaggagttcagcaacattttcgagaaagaccgtgctctggcgcgtcgcttccagaaaattgatattactgaaccgtcgatcgaagaaactgttcaaatcatcaatggcctgaaaccgaagtatgaagcgcaccacgacgtgcgttataccgcaaaagcggtgcgtgcggcggtagagctggcggtgaaatacattaacgatcgtcatctgccggataaagccattgatgttatcgacgaagcgggcgctcgcgcacgtctgatgccggtaagcaaacgcaagaaaaccgttaatgtggcggatattgagtccgtggtggcccgtattgcacgcattccagagaagagtgtttctcagagtgaccgcgataccctgaaaaacctcggcgatcgcctgaaaatgctggtcttcggccaggataaagccattgaggcgctgactgaagccattaagatggcgcgtgcaggtttaggtcacgaacataaaccggtcggttcgttcctgtttgccggtcctaccggggtcgggaaaacagaggtgacggtacagctttcgaaagcgttgggcattgagcttctgcgctttgatatgtccgagtatatggaacgccataccgtcagccgtctgattggtgcgcctccgggatacgttggttttgatcagggcggtttgctgactgatgcggtcatcaagcatccacatgcggttctgctgctggacgaaatcgagaaagcgcaccctgacgtgttcaatattctgttgcaggtgatggacaacggtacgctgaccgataacaacggacgcaaagcggacttccgtaacgtggtgctggtgatgaccaccaacgccggggtacgtgaaactgagcgtaaatccattggtcttatccaccaggataacagcaccgatgcgatggaagagattaagaagatctttacaccggaattccgtaaccgtctcgacaacattatctggtttgatcatctgtcaaccgacgtgatccatcaggtggtggataaattcatcgtcgagttgcaggttcagctggatcagaaaggtgtttctctggaagtgagccaggaagcgcgtaactggctggccgagaaaggttacgaccgggcaatgggcgcacgtccgatggcgcgtgtcatccaggacaacctgaaaaaaccgctcgccaacgaactgctgtttggttcgctggtggacggcggtcaggtcaccgtcgcgctggataaagagaaaaatgagctgacttacggattccagagtgcacaaaagcacaaggcggaagcagcgcattaatctgattgtcaggtaggttggtcaagtccgtaatctcgaaagaggttgcggactttttatttatggggtggaggttcagaccctttttttaatgatgatggtaagttgttgataattagtgctgcgggaaggtaaggataaaaaagggtgctgcaggagaatgggatggttttgctttattaacaacgggctaaacgtgtagtatttgagttcactgccgtacaggcagcttagaaaaacctaccgtcttggctagcggttgcagcgaacgttcactgccgtacaggcagcttagaaaggaacaatcttgcaaaggctgtgaaagttggcgttcactgccgtacaggcagcttagaaattcacaggtaacatactccacccaccatgttcactgccgtacagacagataaaatgcgaaaaaaaagctcgcactttcgtacgagctcttctttaaatatggcggtgagggggggattcgaacccccgatacgttgccgtatacacactttccaggcgtgctccttcagccactcggacacctcaccaaattgttttgctgccaaacctcatgggtggcaacggggcgctactatagggagttggagtaaaacggtcaagaagaattttaatgataattattgtttgctcatactgtaaacaacttgtgcagtatatctacatcgagacaagttatggacttatacttccaaagtacttcatacatatcacaaaataaaaaggccggttaaaccgaccttttactcgttctttctcttcgcccatcaggcggtaaaacaatcagcgactacggaagacaatgcggcctttgctcaggtcgtacggggtcagttcaacagtcactttgtcgcccgtcaggatgcggatgtagtttttgcgcattttaccggagatgtgtgcagtaaccacgtgaccgttttctaactctacgcggaacatggtattaggcaacgtttcaagaacggtaccttgcatttcaatattgtcttctttggccatctaatcctctggggtatcactaccgtaatttgaaccggcaagataatgccgaagttctgtaaataagtaaagatttgcgcgctaaatcgcaacaaacaggttcggcacattactccgaaaacacacggctaagccgcaccaaaagcgcaacgtataagggagcggtgagataaacgatgggcgttacctgacgcgaaaaattccttatcggcagcggggtaatgagcgtaaccaactctgcgaccgcaattataacactctggggagaaatgtgccgaaaacattcattcttgtggtgaaaacaagcaccgtggtacccagaaattattcggcaatcgtccgaggcgcatttgattgagataattaaggtaatcccggcggggaatttcgcaggcaccaagcgatgctgtgtgatcgttaaggacctggcagtcgataagcttaccgccatgaccgataaattcctcacagaataccagaagcgccgttttagacgcattttccatccggctgaacatggactcgccacaaaatagtgttccctgggccacgccgtacataccgccgacaagctcatcttcacgccagacttcaatggagtgggcatgaccgagttcgtgaaggcgatggtaggcttcgaccacgccacgcgtgatccaggttccttcttcgcgatcgctggcacagccttcaatgacctgaccaaaagcgtaattcatcgtgacacgatagggcgagcgtttatgaaatcgcttcatactacggctgatatgcagtgattctggccatagcaccgcgcggggatcgggcgaccaccagaggatggggtcgcctggagaaaaccacggaaaaataccacgctggtaagccattaacaggcgcgcagggctaagatcgcccccaagtgccagcaggccgttaggctcacgtaatgcgccttccggggaagggaaggctattgaatggcgagaaagctgaaccaggcgcatgaccgcaaaactccacgcaagtcggatcgttcaataatagcttacaaaccctgcttgaactggtaataacgcccctgtctggcaagcagttctgcgtgagtaccttgctcaataatttgcccgttgtccatcactattatttgttggaaacgagagagtccgcgaagtcgatgggtgaccattaacaccgttttctcacgcatcatttctgcaagcaattcaaggatctggctttcggttgtggcatctaagccttcggtaggttcatccagcaacaccagtggcgcatcatgtaacagcgcacgggcgatagccagacggcgcagttcaccaccggagagctggcgtccgccttcacctaaccaactgttgagacctgcatcctcgagcagcttctccagaccaacgcgacgcaagatctccgacagagcctcatcactactgccaggcgaggcgagtaacagattatcacgcagcgtggcgctaaacagatgcactcgctgaggaacaacgctgatggtctgtcgtagagacgcttcattcaggctggctatggggctatcgttaagcaaaatctcgccctgttgcgggtcccaagcgtgggtcagcagttgtaacagtgttgatttgccgcatccggttcgcccgagaatcgcaatatgttccccggcgtttacctgaagagaaatccctttaagtgcctgttgggattgctccggataagtgaactgaacatcccgtaatgtcagcgaaacgcgatcggcaacacgagtttgggtatcagggaaggtgacttccggtttttgatccgttaaatcagtgatccgaacggcagaggcaatgacttgccccagatgctgaaatgcacccgttactggtgccagtgcttcaaacgcggctaacgcgcagaagacaaacagggcaattaacgcgccgggttgagcattgccgccaacgccgccagacgccatccacagcatcaggatcaccgctaacgcgccaatgagcagcattatcgcttgcgacaatgcggtcagttcagattgacggcgttgcgcttccagccattgaatttctgtattctctagttgcgtgcgataacgatcgctggcaccaaaaatggtcagctcagcttgcccttgcagccaggccgtcagttgttggcgatactgtccgcgaagatgagtcagattttgcccggtgctttttcccgcacgataaaacagcggtggcatcaggaaaagcgtcagtaacataatgccgcccagcgtaaaggcgagggtgaaatcaaggaaacttaacccgattgtcaccaccataatcaccacaaaagcgcccaccagcggcgagataacgcgcaggtaaagatgatcgagcgtatcaacatccgccaccacgcgattgagcaattcgccctgacgatagcgcgccagtccggcaggggagaggggcagcaatttgctgaaggtgtaaatgcgcagatgctgcaacacgcggaaagtcgcgtcgtgacttaccagacgttcaaaatagcgcccggcagtacgggtgattgctgcgccacgcacgcccgcagcgggtagcatatagttgaagctgtacagtccggcaacccccgcaaccgctgaggccgagaggaaccagccggaaagtgtcaacagaccgatactggcgagcagcgtcacaattgccagcacaataccaagacttaacatccatttatgacgtttatacagtgccagatagggtagcaaagcgcgcatttaaatctcctcctgacgatgggccagtaatgtggcgaatgggccaccagccacacttaattccgcgtaacgtccttgctcaataatccggccatcctgcataacccaaatgacatcccagtcagcaagatcttctaactggtgggtgaccattaacgttgtctggcgcagagaggcggcattcagcgcctccattacgcgctgttcactgtgagcatcaaggctggcagcgggttcatccaacagtaatagcgaacagggatttagtaacgcacgggccaccgccacgcgctgcgcctgccccacggaaaggcgggcagcctggtcgccaacaggcgtatcaacgccttgtggcaggagcggtagaaactcgctgacccaggcgttatccagcgctgcttgtaattcttgttcgctggcatcaggtcgcgccagtagtacgttatcccgtaatgttgctgccggtaattgtgggttttgcccaacccaggagagatgtttacgccatgattctggtgataaatcgcgtaattctatcccgttgattcgtaatgatccctgatatgagagaaaaccagaaagcgcgttcagcagtgagcttttacctgaaccgctgcgaccaaccaacactgcacgttggcctgctggcaaagtaaagttcagcggtccggccagcgttttaccttccggcgacgtgataaacagatcctcggcctcaatggtcagcggatcggtcaatgctaattccgcctcaccgcgctgcggatgggcgagcggggtttccataaacgttttcagactgtcagctgcaccaacagcctgggctttagcatgataaaacgtaccgagatcgcgtaatggctggaaaaactctggcgcaaggatcagggccagaaaacccgcagccagcgtcacgccagtatcgtagtgaccaaaatccagctcgccgagataggaaaaaccaaagtagaccgccaccagagcaattgacagcgaggtaaaaaattcgagaatgccggaggataaaaacgccagtcgtagcacttccattgtccgttggcggaaatcttccgaagcagaacgaatactttcaatttcagcttcaccacgaccaaaaatacgcaatgtttccatgccgcgcaggcgatcgaggaaatgcccacttaagcgagcaagagcgagaaagttacgtcggttagcatcggcagcccccattccaaccagcgccataaacaacggaattagcggtgctgtgcccagcagaatgagcgccgcagcccagttagaggggaagatcgccaccacaatcagcaacggcaccgacactgccagcgccatttgcggcagatagcgtgcatagtaatcatgcatatcgtcaatttgctcgagtaccagcgtcgcccagctccccgcaggtttaccctgaatccacgctggccctgcttgttgcagacggtcgagaacctgacggcggatggcaaagcggatatgctgcccggcgtgataacccacccgttcgcgtaaccagaccacccatgcgcgcagtacaaaggtcagaaccagtaacgtaaagggaagcagcagggcttcacggggaatattctccataatcatatgttgcagaattcgcgccatgaaccaggcctgggcaatgatcaatatgccgctcacaaagcccagcagacgagaaatattcagccaacgttgggagatgacgctttgctgttttaaccagcgggttaactctttttgacgagatttattcattgcacgcttagcaggtgagttatcagaattatttgcagagcaatgttacaacggggaaaaaataaaggcgacccatagtcgcatggtgtcgccttctttacttttgttactgatttgtaaaattattttgcgtcagctaaaccatcgaggtagcgttccgcatcaagtgctgccatgcagcctgtaccggccgaagtaatggcctggcgataaatgtgatccatcacgtcgcctgcggcaaagacgccaggaatgctggtctgggtggcattaccatgaatacccgactgtactttgatgtagccgttttccagttccagctgcccttcgaaaatcgcagtattcgggctgtgaccgatagcaacaaacagaccggcaacgtcgagtgactcgatgttatcgctgttttgcgtatcgcgcagacgaacgccagtgacacccatttgatcgccggtcacttcttccagcgtacggttggtgtgcagaatgatgttgccgttctccactttatccatcaggcgcttaatgaggattttttccgcgcggaaaccgtcacggcggtgaatcagatgcacttccgaagcgatgttagacagatacagcgcctcttcaaccgcggtattgccgccgccgatgaccgcaactttctggttgcgatagaagaaaccgtcgcaggttgcacaagcagaaaccccacggcctttaaaggcttcttcagagggcaggccgagatagcgtgcagaagctccggtggcaataatcagcgcgtcgcaagtgtattcgccgttatcgccattcagacggaacggacggttttgcagatccaccttgttgatatgatcaaaaatgatctcagtttcaaacttggtggcatgttcgtgcatgcgctccattaataacggaccggtcagatcgtttggatcgccaggccagttttccacttccgtggtggtggtcagttggccgcctttttccatgccggtaatcagcacaggttgcaggttggcgcgcgccgcgtagacagcagcggtgtatcccgccgggcctgaacccaggataagcagtttactgtgtttggtcgtgcccatgagatccccatagttgttggcagacaatgggcaggattgtagggaatttacagacgtaaaaaaagagtatgacgattttgttaacaatttgtgcaatcggcagcatcgataagcaggtcaaattctcccgtcattatcacctctgctacttaaatttcccgctttataagccgattaaatgatgaataaacgcccctgttaatgaatatctggcatgttgtactaaaaatcgatgttttgctttgacaatcccctggtgttttgcgaaaacattcgaggaagaaaaaaaacagtattcttatatgcgcataaccatgcatgtaaataccatgtttaccgtgctagtgaaatctacgtatggcgtggacagacgccattcgtgatgtcgatagctgccacaaggcaacggtcttctcaccgtagacccaggcattgcgcgccgtgaatcttcatgatttcggtctatcgtgacgggtagcgactctgaacagtgatgtttcagggtcagacaggagtagggaaggaatacagagagacaataataatggtagatagcaagaagcgccctggcaaagatctcgaccgtatcgatcgtaacattcttaatgagttgcaaaaggatgggcgtatttctaacgtcgagctttctaaacgtgtgggactttccccaacgccgtgccttgagcgtgtgcgtcggctggaaagacaagggtttattcagggctatacggcgctgcttaacccccattatctggatgcatcacttctggtattcgttgagattactctgaatcgtggcgcaccggatgtgtttgaacaattcaataccgctgtacaaaaacttgaagaaattcaggagtgtcatttagtatccggtgatttcgactacctgttgaaaacacgcgtgccggatatgtcagcctaccgtaagttgctgggggaaaccctgctgcgtctgcctggcgtcaatgacacacggacatacgttgttatggaagaagtcaagcagagtaatcgtctggttattaagacgcgctaacacggaacaggtgcaaaatcggcgtattttgattacactcctgttaatccatacagcaacagtactggggtaacctggtactgttgtccgttttagcatcgggcaggaaaagcctgtaacctggagagcctttcttgagccaggaatacactgaagacaaagaagtcacattgacaaagttaagtagcggccgccgccttctggaggcgttgctgatccttattgtcctgtttgccgtctggttgatggctgccttactaagctttaacccttcggaccccagctggtcgcaaacggcctggcatgaacctatccataatttaggtgggatgcccggtgcgtggttggcagatacgctgttctttatttttggcgtgatggcttacaccattcccgtcattattgtcggcggttgttggtttgcctggcgtcatcagtccagcgacgaatacattgattattttgccgtttcgctacgcatcattggcgttttggcgctcatccttacctcctgtggtctggcggcaatcaacgctgacgatatctggtattttgcctccggtggcgtcattggcagcttactaagcactacgctacaaccactgctacacagtagcgggggaactattgcgctgctctgcgtttgggcagcgggcctgacgttgttcaccggttggtcatgggtgaccattgctgaaaaactcggcggctggattttaaacattctcaccttcgccagtaatcgtacccgtcgcgatgatacctgggtcgatgaagatgagtatgaagacgacgcagagtatgaagatgaaaatcacggcaaacagcatgaatcacgccgtgcccgtattcttcgcggcgcgctagcgcgtcgtaaacggttggcggaaaaattcattaatccgatggggcggcaaacagacgctgcgttgttctccggtaagcggatggatgatgacgaagagattacctacactgcacgcggtgtggctgccgacccggacgacgtcctattttcgggcaatcgtgcaacgcagccagaatatgacgaatacgatccattattaaacggtgcgccaattaccgaacctgtcgctgtagcagctgctgctaccacggcgacacaaagctgggctgcgccggttgaacctgtgactcagacgccgcctgttgcctctgttgatgttccacctgcgcaacctacagtagcctggcagcctgtaccgggtccacaaacgggagagccggttattgctcctgcaccggaaggttacccacagcagtcacaatatgcgcagcctgcagtgcaatataatgagccgctgcaacaaccagtacagccgcagcagccgtattatgcacctgcagctgaacaacctgcgcaacagccgtattatgcccctgcgccagaacaaccggtggcaggtaacgcctggcaagccgaagagcagcaatccacttttgctccacagtctacataccagactgagcaaacttatcagcagccagccgctcaggagccgttgtaccaacagccgcaacccgttgaacagcagcctgttgtggagcctgaacccgttgtagaagagacaaaacccgcgcgtccgccgctttactactttgaagaagttgaagagaagcgagcccgtgaacgtgaacaacttgcggcctggtatcaaccgattccagaaccggttaaagaaccagaaccgatcaaatcttcgctgaaagcaccttctgttgcagcagtacctccagtagaagccgctgccgctgtttccccgctggcatctggcgtgaaaaaagcgacactggcgacgggggctgccgcaaccgttgccgcgccagtcttcagtctggcaaatagcggtggaccgcgtcctcaggtcaaagaggggattggtccgcagttgccacgaccgaaacgtatccgcgtgccaactcgtcgtgaactggcgtcttacggtattaagctgccctcacagcgtgcggcggaagaaaaagcccgtgaagcccagcgcaatcagtacgattctggcgatcagtacaacgatgatgaaatcgatgcgatgcagcaggatgaactggcacgtcagttcgcccagacacagcagcaacgctatggcgaacagtatcaacatgatgtgcccgtaaacgcagaagatgcagatgctgcggcagaggctgaactggctcgtcagtttgcgcaaactcaacaacaacgttattccggcgaacaaccggctggggcgaatccgttctcgctggatgattttgaattttcgccaatgaaagcgttgctggatgatggtccacacgaaccgttgtttacgccaattgttgaacctgtacagcagccgcaacaaccggttgcaccgcagcagcaatatcagcagccgcaacaaccagttccgccgcagccgcagtatcagcagccacaacagccggttgcgccgcagccacaatatcagcagccgcaacaaccggttgcgccacagcagcaatatcagcagccgcaacaaccggttgcgccgcagcagcagtatcagcagccacaacagccagttgcgccacaaccgcaggataccctgcttcatccgctgttgatgcgtaatggcgacagccgtccgttgcataaaccgacgacgccgctgccttctctggatttgctgacaccgccgccgagcgaagtggagccggtagatacctttgcgcttgaacaaatggctcgcctggtggaagcgcgtctggctgatttccgtattaaagccgatgtcgtcaattactctccggggccggttatcactcgctttgaattgaacctggcaccgggcgtaaaagcggcgcgcatttctaacttgtcacgggaccttgcccgttcactttcgacggtggcggtgcgtgtcgttgaagttattcctggcaaaccctatgtaggtctggagttaccgaataaaaaacgacaaaccgtttatctgcgcgaagttttggataacgccaaattccgcgataatccgtcgccattaaccgtggtgctgggtaaagatatcgccggtgagccggtggttgccgatctggcgaaaatgccgcacttgttggttgcggggactaccggttccggtaaatctgtcggtgtgaacgcgatgatcctgagcatgctttataaagcacagccagaagatgtgcgtttcatcatgatcgacccgaaaatgctggagctttcggtttatgaaggcattccgcatctgttaacggaagtcgttactgatatgaaagatgccgccaacgcgctgcgctggtgtgttaacgagatggagcgtcggtataaactgatgtctgcgctgggtgtgcgtaatctggcgggttataacgaaaaaattgctgaagccgatcgcatgatgcgtccgattccagacccgtactggaagccgggtgacagtatggatgcccagcatccggtgctgaaaaaagaaccatacattgtggtgttggttgacgaatttgccgacctgatgatgacggtaggtaaaaaagtggaagagctgatagcacgtctggcgcaaaaagcccgtgccgcgggtatccacctcgtactggcaactcagcgtccatcggttgatgttattactggtctgattaaagcgaatattccgacccgtatcgcctttaccgtatccagtaagattgactcacgtaccattcttgatcaggctggcgcggaatcactgctgggtatgggggatatgctctactctgggccgaactccacgttgccggtacgtgtccatggtgcttttgttcgcgatcaggaagttcatgccgtggtgcaggactggaaagcgcgtggtcgcccacagtatgttgatggcatcacctccgacagcgaaagcgaaggtggtgcgggtggtttcgatggcgctgaagaactggatccgttgttcgatcaggcggtgcagtttgtcactgaaaaacgcaaagcgtcaatttctggcgtacagcgtcagttccgcattggttataaccgtgcagcgcgtattatcgaacagatggaagcgcaggggattgtcagcgaacaggggcacaacggtaatcgtgaagtgctggccccaccgccgtttgactaattaatgcattgccggataaggcgcggtagcgtcgcatccggcactctatcaactgaaaattcagtattttcttctttcctcaagctgattattagcctggaatagagagtagagggaactcccgatcgggagtgacgtaatttgaggaataatgatgaaaaaaattgccatcacctgtgcattactctcaagcttagtagcaagcagcgtttgggctgatgccgcaagcgatctgaaaagccgcctggataaagtcagcagcttccacgccagcttcacacaaaaagtgactgacggtagcggcgcggcggtgcaggaaggtcagggcgatctgtgggtgaaacgtccaaacttattcaactggcatatgacacaacctgatgaaagcattctggtttctgacggtaaaacactgtggttctataacccgttcgttgagcaagctacggcaacctggctgaaagatgccaccggtaatacgccgtttatgctgattgcccgcaaccagtccagcgactggcagcagtacaatatcaaacagaatggcgatgactttgtcctgacgccgaaagccagcaatggcaatctgaagcagttcaccattaacgtgggacgtgatggcacaatccatcagtttagcgcggtggagcaggacgatcagcgcagcagttatcaactgaaatcccagcaaaatggggctgtggatgcagcgaaatttaccttcaccccgccgcaaggcgtcacggtagatgatcaacgtaagtagaggcacctgagtgagcaatctgtcgctcgatttttcggataatacttttcaacctctggccgcgcgtatgcggccagaaaatttagcacagtatatcggccagcaacatttgctggctgcggggaagccgttgccgcgcgctatcgaagccgggcatttacattctatgatcctctgggggccgccgggtaccggcaaaacaactctcgctgaagtgattgcccgctatgcgaacgctgatgtggaacgtatttctgccgtcacctctggcgtgaaagagattcgcgaggcgatcgagcgcgcccggcaaaaccgcaatgcaggtcgccgcactattctttttgttgacgaagttcaccgtttcaacaaaagccagcaggatgcatttctgccacatattgaagacggcaccatcacttttattggcgcaaccactgaaaacccgtcgtttgagcttaattcggcactgctttcccgtgcccgtgtctatctgttgaaatccctgagtacagaggatattgagcaagtactaactcaggcgatggaagacaaaacccgtggctatggtggtcaggatattgttctgccagatgaaacacgacgcgccattgctgaactggtgaatggcgacgcgcgccgggcgttaaatacgctggaaatgatggcggatatggccgaagtcgatgatagcggtaagcgggtcctgaagcctgaattactgaccgaaatcgccggtgaacgtagcgcccgctttgataacaaaggcgatcgcttttacgatctgatttccgcactgcataagtcggtacgtggtagcgcacccgatgcggcgctgtactggtatgcgcgaattattaccgctggtggcgatccgttatatgtcgcgcgtcgctgtctggcgattgcgtctgaagacgtcggtaatgccgatccacgggcgatgcaggtggcaattgcggcctgggattgctttactcgcgttggcccggcggaaggtgaacgcgccattgctcaggcgattgtttacctggcctgcgcgccaaaaagcaacgctgtctacactgcgtttaaagccgcgctggccgatgctcgcgaacgcccggattatgacgtgccggttcatttgcgtaatgcgccgacgaaattaatgaaggaaatgggctacgggcaggaatatcgttacgctcatgatgaagcaaacgcttatgctgccggtgaggtttacttcccgccggaaatagcacaaacacgctattatttcccgacaaacaggggccttgaaggcaagattggcgaaaagctcgcctggctggctgaacaggatcaaaatagccccataaaacgctaccgttaatgttatcgttgcggtaatgttgttactgtatccctgtggtcgcaggctgtggccacatctcccatttaattcgataagcacaggataagcatgctcgatcccaatctgctgcgtaatgagccagacgcagtcgctgaaaaactggcacgccggggctttaagctggatgtagataagctgggcgctcttgaagagcgtcgtaaagtattgcaggtcaaaacggaaaacctgcaagcggagcgtaactcccgatcgaaatccattggccaggcgaaagcgcgcggggaagatatcgagcctttacgtctggaagtgaacaaactgggcgaagagctggatgcagcaaaagccgagctggatgctttacaggctgaaattcgcgatatcgcgctgaccatccctaacctgcctgcagatgaagtgccggtaggtaaagacgaaaatgacaacgttgaagtcagccgctggggtaccccgcgtgagtttgactttgaagttcgtgaccacgtgacgctgggtgaaatgcactctggcctcgactttgcagctgcagttaagctgactggttcccgctttgtggtaatgaaagggcagattgctcgcatgcaccgcgcactgtcgcagtttatgctggatctgcataccgaacagcatggctacagtgagaactatgttccgtacctggttaaccaggacacgctgtacggtacgggtcaactgccgaaatttgctggcgatctgttccatactcgtccgctggaagaagaagcagacaccagtaactatgcgctgatcccaacggcagaagttccgctgactaacctggtgcgcggtgaaatcatcgatgaagatgatctgccaattaagatgaccgcccacaccccatgcttccgttctgaagccggttcatatggtcgtgacacccgtggtctgatccgtatgcaccagttcgacaaagttgaaatggtgcagatcgtgcgcccagaagactcaatggcggcgctggaagagatgactggtcatgcagaaaaagtcctgcagttgctgggcctgccgtaccgtaaaatcatcctttgcactggcgacatgggctttggcgcttgcaaaacttacgacctggaagtatggatcccggcacagaacacctaccgtgagatctcttcctgctccaacgtttgggatttccaggcacgtcgtatgcaggcacgttgccgcagcaagtcggacaagaaaacccgtctggttcataccctgaacggttctggtctggctgttggtcgtacgctggttgcagtaatggaaaactatcagcaggctgatggtcgtattgaagtaccagaagttctgcgtccgtatatgaacggactggaatatattggctaatacccaatttttctgaatctaaaaagcgcctgcgggcgctttttttgtctccctttgataccgaacaataattactcctcacttacacgtaatactactttcgagtgaaaatctacctatctctttgattttcaaattattcgatgtatacaagcctatatagcgaactgctatagaaataattacacaatacggtttgttactggaatcaatcgtgagcaagcttgagtgagccattatgaaaacgaaaatccctgatgcggtattggctgctgaggtgagtcgccgtggtttggtaaaaacgacagcgatcggcggcctggcaatggccagcagcgcattaacattaccttttagtcggattgcgcacgctgtcgatagcgccattccaacaaaatcagacgaaaaggttatctggagcgcctgtacagttaactgtggtagtcgctgcccgctacgtatgcacgtcgtggacggtgaaatcaaatatgtcgaaacggacaataccggcgatgacaattacgacggcctgcaccaggttcgcgcctgcctgcgtgggcgttccatgcgtcgccgtgtctacaatccggaccgcctgaaatatccgatgaaacgagtcggggcgcgcggtgaaggcaaattcgagcgcattagctgggaagaagcctacgacatcatcgcgaccaatatgcagcgcctgatcaaagagtacggcaacgagtctatctatctgaactatggcaccggtacgctgggcggcaccatgacccgctcctggccgccgggaaataccctggtcgcgcggctgatgaactgctgcggcggctatctgaaccattacggcgactactcctccgcgcaaattgcggaaggtttgaactatacctacggcggctgggcagatggcaacagcccgtcggatatcgaaaacagtaagctggtagtgctgtttggtaataaccctggcgaaacgcgaatgagtggcggtggggtgacttactatcttgaacaggcacgccagaaatctaatgcccgcatgatcatcatcgatccgcgctataccgacaccggtgccgggcgcgaagatgagtggatccctattcgtccgggaacagatgccgcactggttaacggtctggcgtacgtcatgatcactgaaaacctggtggatcaggcattcctcgataaatattgcgttggctacgatgagaaaaccctgccagccagtgcgccgaaaaatggccactataaagcttatattctgggtgaagggccagatggcgtggctaaaacgccggaatgggcctcgcaaatcactggtgttccggcagacaaaatcatcaaattggctcgtgaaatcggtagtaccaaaccggcgtttatcagccagggatggggcccgcagcgtcacgctaacggtgaaatcgcaacccgtgctatctcgatgctggcgattctgaccggtaacgttggtattaacggaggcaacagcggcgcgcgtgaaggttcatacagcttaccgtttgtccgtatgccgaccttggaaaacccgatccagaccagcatttcgatgtttatgtggaccgatgccattgaacgtggcccggaaatgacggcgctgcgtgatggtgtacgcgggaaagataagctggatgtgccgatcaaaatgatctggaactatgccggtaactgcctgattaaccagcattctgaaatcaaccgtacccatgaaatccttcaggatgataagaagtgcgagctgattgtggttatcgactgccacatgacctcatcggcgaaatatgctgacatcctgctgcctgactgcaccgcttccgaacagatggactttgcgctggatgcatcctgcgggaatatgtcttacgtgattttcaacgatcaggtgattaaaccgcgctttgaatgtaagaccatctatgaaatgaccagcgaactggcaaaacgtcttggcgttgagcaacagtttactgaaggccgtacccaggaagagtggatgcggcatctgtatgcccagtcgcgggaagcgattcctgaactgccaacgtttgaagagttccgcaagcaggggatctttaaaaagcgcgacccacaagggcatcacgttgcttataaagccttccgtgaagatccgcaggcaaacccactgactacgccatcgggcaaaattgagatttattcgcaggcgctggctgacattgccgctacctgggaattgcctgaaggcgatgtgatcgatccactgccgatctacacgccgggctttgaaagttatcaggatccgctgaacaaacagtatccgctgcagcttacaggtttccactataaatctcgcgttcactcaacttacggcaacgttgatgtgctgaaagcggcttgccgtcaggaaatgtggatcaacccgcttgatgcccaaaaacgcggtatccacaacggcgataaagtcaggatctttaacgatcgtggtgaggttcatattgaggcgaaagtgacgccacgaatgatgccgggtgtggtcgcactgggtgaaggtgcctggtatgacccggatgcaaaacgtgtcgataagggtggttgtattaacgtactgaccactcaacgtccgtctcctctcgctaaggggaatccgtcacatacaaaccttgttcaggttgaaaaggtgtaaggagtaaccgatgacaacccagtatggattttttattgattccagccgttgcaccggttgcaaaacctgcgagctggcctgtaaagactacaaagatttgacgccagaagtcagcttccgccgcatttatgaatatgctggcggcgactggcaggaagataacggtgtctggcaccagaacgtgtttgcctactatctgtcgatttcatgtaaccactgcgaagatccggcttgtactaaagtctgcccgagcggtgcgatgcataaacgtgaagatggttttgttgtggtcgatgaagatgtgtgcattggctgccgctactgccatatggcttgcccgtatggcgcaccgcaatataacgaaacgaaaggccatatgaccaaatgcgatggttgttatgaccgtgttgcggagggtaaaaagccgatctgtgttgaatcttgtccgctgcgggcgctggatttcggccctatcgacgagctgcgtaaaaaacatggcgatctggcggccgttgcgccgttgccgcgagctcactttaccaaaccgaatattgtgatcaaacccaatgccaatagccgcccgaccggggataccactggctatctggcaaacccgaaggaggtgtgagatgggaagtggatggcatgaatggccgctgatgatcttcacggtcttcgggcaatgtgtagcaggtggttttatcgttctggctttggcgctgctcaaaggcgacctgcgagcagaagcccagcagcgtgttatcgcctgcatgtttggtttatgggtgctgatgggcattggctttatcgcctctatgctccatcttggttcaccaatgcgcgcttttaactcgctcaaccgggtaggggcttcagcactcagtaacgaaatcgccagcggttcgatcttttttgccgtaggcggcatcggctggttgctggcaatgctgaaaaagctgtcaccggcattgcgtacgctgtggctgatagtgacgatggttcttggcgtcatctttgtctggatgatggtgcgtgtgtataacagcattgataccgttccgacctggtacagcatctggacgccgatgggcttcttcctgacgatgtttatgggcggcccgttactgggttacctgttgttgagtctggctggcgtcgatggctgggcgatgcgtctgctgccagcaatttctgtactggcactggtagtgagtggcgtggtgtcagtgatgcagggcgcagagctggcgactattcatagttctgtgcagcaggccgcagcgctggtgccggactatggtgcgctgatgtcctggcggatcgtgcttttggccgttgccctgtgcttgtggattgcaccacagctaaaaggttatcagcctgcggttccgctactttctgtatcattcattctgcttctggcaggggaattaatcggtcgcggcgtattctatggtttgcatatgaccgtggggatggccgtcgcaagctaatcataacaaccggggtttcggccccggttctcttttatttctgcttcgttaacgtgtcataactggtcatcaaattacgataatcaggaatgtggttagagaacaacgtcgccagtccttcaatatcattacgccagtcgcgatgcagctcgcacgccacgccgaaccatgtcatcaattgcgcaccagcttgcgacaagcgatcccatgccgaatgccgggtaatttcattaaaggtccctgacgcgtcagtcacgacaaagacgtcaaacccttcttcaatggctgaaagcgccgggaatgccacgcaaacttcggttaccacaccggcaataattaactgttttttacctgtcgctttgacagcttttacaaaatcttcgttatcccaggcgttaatatttcccgggcgagcaatgtaaggtgtatcggggaattgtgctttcagttctggaactaatgggccgttaggaccggtttcaaaactggtggtaagaatagttggtaagttgaaatacttagccaggtcacccagcgccagcacgttatttttaaacttatcgggttcgatatcccgtacaagggaaagtaaaccagcctggtgatcaacaagcaaaacggcagcatcatttttatcaagacgaacatacggtttggtcatcctcttctcctttcgagagtcagtggtacgtctgaaatcgatcagacgcgatgcattgctctgaaagcatagacgggaaatatgagtttgctgtgaccatgaaatttttcgactgaacgaagcgtatgaaatttgtgttagttcaataaaaacaatcagatgagactaatcatctcttcagcattagcgttatgaatgagtaatataaatcgataataccgccgctgggatatcgcgtattttcacccattgacaatgtttttggcggtggcatgatgcgcatgaaatttgaacttcctcacggttttaattcatgtccacgtatacccagcctgtcatgcttttgctgtctggcctgcttttgttgactctggcgattgcggtgttaaatacactcgtgccgctttggctcgcccaggaacacatgtccacatggcaggtaggcgttgtcagctcatcctattttaccggcaaccttgtcggtacattgctgacagggtatgtcattaagcgcattggctttaaccgcagctattatctggcctccttcatttttgccgctggctgtgccggccttggcctgatgattggattctggagctggttggcttggcgttttgtcgcgggcgtcggctgtgccatgatttgggtggttgttgagagcgcgctgatgtgcagtgggacgtcacgtaaccgtgggcgtttgcttgctgcgtatatgatggtttattacgtgggaacgtttttaggccagttactggtcagcaaagtttcaaccgagctgatgtccgtattgccgtgggttacaggtttgacgttggcagggatcttaccgctgttgtttacgcgtgtgctgaatcagcaggctgaaaaccatgattcgacgtcaattacgtcaatgctaaaactccgtcaggcgcggcttggcgtgaatggctgcattatctcaggaatcgttctgggatctctatatggcctgatgccgctgtacctcaatcacaaaggggtgagcaatgccagcattggtttctggatggcggtactggtcagtgcgggtatccttggacaatggccgattggacgtctggcggataagtttggtcgactgctggtgttgcgtgttcaggtctttgtcgtcattctcggcagtatcgcgatgcttagccaggcggcgatggccccagcgttattcatcctcggtgccgctggctttacgctatatccggtggcgatggcatgggcttgcgagaaagttgaacatcatcaactggtggcgatgaaccaggccttactgttgagctatactgtgggaagtctgcttggcccgtcatttaccgctatgctaatgcagaatttctccgataatttattgtttatcatgatcgccagcgtatcgtttatctatttgctgatgctgctgcgcaacgccggtcatacgccgaaacccgttgctcacgtgtaaatgaattcaagcagagtgtgaacttactgtttcacactctgcttttttgtttcttctatctgacttgctttattccaaattttattcgtttaaaaataaaatgtgcagcaggttataattttgcatttcgctatttccgcacttcttatttgccgcgcataatccctcgttttacagatgcccctttaattttggcgaaggatttgtctatggctgggaatgttcaggaaaaacagttgcgatggtacaacattgcgctgatgtcttttatcactgtctggggttttggcaacgttgttaataactatgccaaccaggggctggtggttgttttttcatgggtgtttatctttgcactctatttcacaccttatgcgctaattgttggtcagttaggctcgaccttcaaagatgggaagggcggggtcagtacctggattaaacacacgatgggacccggactggcttatctcgccgcgtggacctactgggtggtgcatattccctatctggcacaaaaaccccaggcaattctgattgcgctcggttgggcgatgaaaggcgacggttcgctaatcaaagaatattcagtcgtagcgttacaggggttaacgctggtgctgtttatcttctttatgtgggttgcttcacgcggtatgaaatcgctgaaaatcgtcggttctgtggcagggattgctatgtttgttatgtcgctcctgtatgtggcgatggcggtaaccgcgcctgcaattactgaagtgcatattgcgaccacaaacattacctgggaaacgttcattcctcatatcgactttacctacattaccactatttcaatgctggttttcgcggttggcggagcagagaagatttctccttacgttaatcaaacgcgcaacccaggaaaagaatttccaaaagggatgttatgcctggcggtgatggttgcggtttgtgccattctgggctcgctggcgatggggatgatgtttgattcgcgtaatatcccggatgacttaatgaccaacggtcagtattacgcctttcagaagctgggcgagtattacaacatgggtaatactttaatggtgatttacgccattgcgaataccctgggacaagtagcggcgctggtattctcgattgatgccccgcttaaagtgctattaggtgatgctgacagcaaatatattccagccagtttatgtcgtaccaacgcttctggtacgcccgttaatggctattttctgaccctggtactggtggcgattctgattatgctgccgactctcggcattggtgatatgaacaatctctataaatggctgttgaaccttaattcggtagtgatgccgctgcgttatttatgggtatttgttgcatttattgcagtcgttcgcttggcgcagaaatataaaccagaatatgtctttattcgtaataagcctctggcaatgaccgtcgggatttggtgttttgcctttaccgcctttgcctgtttgacggggatcttcccgaaaatggaagccttcactgcagagtggaccttccagttggcgctgaatgttgcaacgccgtttgtgctggtaggattaggactgatattcccgctgctggcgcgtaaagcgaatagtaaataattattgtggtcggtgacgctgactctggcagatctgacccgtttttacataatcgagaaatgcgcgcaagccgcaggacatatactggcggtttggataatagatctggaagcctggacgctctgtgctccagtcttccagtacacattctaaacgaccagtatcaaggtactccttgatctgttcatagagcagatacccgataccagcacccatcaaaacggcctccagttcagcatcaacatcatccagaatgatatttcctgcgacagcaatttccagctcctttgcaaattgccagtggaaaggtttgccgctgggataacgaaaaacaacacattgatgattaagcagatcatgaggatggcggggtttgccatatcttgcaaagtactctggcgttgctgctacacataatttcactggcgggccgatcgccacgctgatcatatctttttcgacgatgcaactaagtcgaacgccagcgtcaaagccctgttggacgatatcgacaagagagtcgtcagttgtgagctcgactttaatatcaggatattcacgtgtgaaaccaaccagtaaagacattaaaaatatacgtgcagctacccgggcggcattgattttgagcgttcctgtcggtgtcagacgaaaatcattcatctcatctaacatgatctgaatttcgtcgaaagctgggcgcaatcgttcatagagattagaacccgcttccgttaacgatacgcttcgggttgtccgattgaataagcgaattttaagacgttgttccagtgttttaatactatggctaatggcggacgaggataagcctaactcatcgcccgctgcacgaaagctttgattacgggccacggcaaagaaagtggcaaagtcagacatattcatccgcattagtgaaaatccttcattaactcatcctgaatcatcacgtttacaggattatgccgcctgcgtaaagtgcgctccagaacttaacgtggaggtaaaattatgcagtctgaacgtatttatttggtatgggcccatcctcgtcatgattcattgaccgcacatattgctgatgcgatccatcagcgggcaatggagcggaaaatacaggtgacggaactcgatttatatcggcgtaatttcaacccagtgatgacgccggaagatgaaccagactggaagaatatggataaacgttattctccagaggttcatcagctttattcagagctgcttgaacatgacacgttagtggtggtttttcctctctggtggtacagcttcccggcaatgctaaaaggatatattgacagagtatggaataatgggctggcttatggagatgggcacaaattaccattcaataaagttcgttgggtggcgctggttggaggagacaaagaatcatttgtccagatgggctgggaaaaaatataagcgattatttaaaaaatatgtgcagttatcttggtattgaagatgccgatgtcactttcttgtgtaatacagtggtattcgatggggaagaacttcacgcgagctattatcagtcgttattatctcaggtacgggatatggtagatgcactataagatgtgttaaaaacgctgtagcagaatgaagcgcggaataaaaaagcggcaactcaataaagttgccgctttacggggaaattagaacattaccttatgaccgtactgctcaagaatgcctttcacgcgttccatggtctctttcttcggtggtttaacaccgtcgagtttgtactcttcacccattgccacccatttgtgtttgcccagctcgtggtaggggagaagctcgattttctcaacgttgcccatatcacgggtaaattcaccgaggcgatgcgctgaatcgtcatcgtcagaccagcctgggacaacaacgtagcggatccacaccttcacatttttgttcgccagatatttagcgaactccagcgtgcggtggttggaaactccaaccagattttggtggatctcgtcgttcatctgtttgagatcgagcattaccaggtcggttacttccagcagttcatcaatcaccggatcgtaacgacgaacaaaaccgttggtgtccagacaggtatgaatgccttcttttttgcaggcgcggaaccagtcacgaacaaactcagcttgcaggattgcttcaccgccggatgcggtaacgccgccgccggaagcgttcataaagtggcgataggtcaccacttccttcatcaaatcttcaacggtaacttctttaccgccatgcgtgtcccaggtgtcgcggttatgacaatacaggcagcgcatcaggcagccctggaaaaaggtgataaagcgaatacccgggccgtctacggttccacaggattcaaaggagtgaatgcgaccaataactgacattgcggtgtttctccagatgtggcccatctgaggccgtgttggtgcgcagctcgaaggctacgtcgagtctgttttggcagtcaccttaaagtatagatagctgacaaaaaaggctctcgcgctaaaaaaggccccactttcgtggagcctttattgtacgctttttactgtacgatttcagtcaaatctaattacatagattgagtgaaggtacgagtaataacgtcctgctgctgttctttagtcagcgagttgaaacgtactgcgtagccagatacacggatggtcagctgcggatatttttccgggttttccatcgcgtcgagcagcatttcacggttcatcacgttaacgttcaggtgctgaccaccttcgatggatgcttcgtggtggaagtaaccatccatcagaccagccaggttggtcttacgaacttcgtcgtctttacccagtgcgttcggaacgatagagaaggtgtaggagataccatctttagcgtaagcaaacggcagtttagcaacggaagtcagagaggctactgcacctttctggtcacgaccgtgcatcgggttagcacccggtccgaacggcgcgccagcacgacgaccgtctggggtgttacccgttttcttaccatacacaacgttagaagtgatggtcagaacagactgagtcgggatagcgtcacggtaggtgtgcagtttctgaattttcttcatgaaacgttctaccaggtcaacagccaggtcatctacacgcggatcattgttaccaaactgcgggtattcgccttcgatttcgaagtcgatagccagaccgtcttcgtcacgaatcggtttaactttcgcatatttgattgcagacagggagtcagcagcaacggacagaccagcgataccacacgccatggtgcggataacgtcacggtcgtgcagcgccatcagagaggcttcgtagctgtacttgtcgtgcatgtagtggatgatgttcagtgcagtgatgtactgtttagccagccagtccatgaagtgatccatgcgctccatcacttcatcatagttcaggacatcgcctttgatcggttcagacttcggaccaacctgcattttcagtttttcgtcaacgccgccgttgattgcgtacagcatggttttcgccaggtttgcacgcgcaccgaagaactgcatttgtttaccaacgatcatcgggcttacgcagcaagcaatagcgtagtcatcgttgttgaagtccggacgcatcaggtcatcgttctcatactgcagagaagaggtgtcgatggacactttagcggcgaatttcttgaagttcagcggcagtttttcagaccacagaatggtcatgttcggttccggagacggacccatggtgtacagggtgttcaggaaacggaagctgtttttggtaaccagggtacgaccgtcgaggcccataccaccgatagattcggttgcccagatcgggtcgccagagaacagttcatcgtattccggagtacgcaggaagcgaaccatacgcagtttcatgaccaggtggtcaaccatttcctgcgcttcttgttcggtgatcttgccagctttcaggtcacgttcgatgtacacatccaggaaggtggaggtacgaccgaaggacattgcagcaccgttctgagacttaacagcagccaggtagccgaagtaagtccactggatagcttcctgagcgttggtagccggaccagagatgtcgtagccgtatttcgcagccatttctttcatctgacccagagcgcggtgctgttcagcgatttcttcgcgcagacggatagtctgttccaggtttacgccgttttccagatcagcctgcagagaagtgaactgtgccagtttgtctttcatcaggtagtcgataccgtacagcgcaacgcgacggtagtcaccgatgatacggccacggccatatgcatctggcagaccggtcagaacaccagatttacggcaacgcaggatgtccggagtgtaaacgtcgaacacgccctggttgtgagttttacggtattcagtgaagatttttttgatcatcggatccagttcgcggttgtacgctttgcaggaaccttcgatcattttgataccaccaaacgggataagagcacgtttcagcggagcttcagtctgcagaccaacgattttctcaagctgcttgttgatgtagccagcgtcgtgagaggtgatggtggaagcaacagcggtgtcaaagtcaactggcgcgtgagtgcggttttccagtttaacgccttccattactttgtcccacagggtggtggtcgcttcagtagcgccagccaggaaggactcgtcaccctcgtacggagtgtagtttttctgaatgaagtcacggacgtttacttcattctgccagtcacctttggtaaaaccttcccaggctgtggctaacttttcattaagctcggacatgtaacacctaccttcttaagtggattttttatttactgcgtacttcgacaaccattaatggtggtcgttttcacgcaggtaaatgacccagtatgtcaacccaaccaacaaaccaccaccgataatgttgccgatcgtaaccggaatcaggttatcagtgatgaaattcatcacggtcaggtgagaaaaattttccggtgcagaaccgactgcggtccaaaattccggggatgcgaagtcgcggattacaatacccatcgggatcataaacatgtttgcgatactgtgctcaaaaccgctggcaacaaacatcgcgaccggcagcaccataatgaacgctttgtccatcaggctgcggccagaataactcatccatactgccagacataccatcaggtttgccaggataccaagacagacggcctcaataaaagtatggtgcactttgtggtcggcggtttgtaggacgtttagtccccattgaccatttgcggtcatatactcgccggaaagccacattaaaagtacaaacagcagtgcgccgaccaggttgccaaaatagacatttagccagtttttcgccaactgaccccaggtgatgcgcccactcgccttagcaacaacaatcaacacggtggaagtaaagagatcggctccgcagacaacacaaagaatcagccccagagagaagcaaatgccgccaaccagttttgccatgccgaagggcattgtgcctgtgccagtggttgctgtgatatagaagacgaatgcgattgagatgaaaacaccggcggtaatcgccagatagaaagtcttaagcggatgtttcgttgctttatagacacccgcctcttcggccactttggccattgcagcaggaagtaaaagatcaaaagggttgtcagctttcacactaactctctctttattaagtcggcgacgagatactaacaaagcattatagatgagaaattgatatagatcatatctcgcctggcttataggcccgtaactcgcatggtttttatgcaaatacggagtaaatatttgattatccaaataaaaataaattttaaaaattaacaaatgagttgaattttttccgcatcctccgctaaaacagttaattaaaagggagcatcaggcgaataaagtaacaatatcgatcgtatttattaaatacaaattaccgatatttaaccttataattacaattattttattaatgcaaatatatgtaaagcggggcattaaaaaaacgccccgtaatataactcagactaatcattaagcctacattgcgtaggctatttgattttattttgcccagaatgctgctttggcgcgctgcagcttttcgtaggccttcaacaacgactgatgtgcagcaaacgcgtgcagatcgctatctaccggttgcaggccgtaaaacgccgcttcgccgctcattgccgcactggcggcttctacggcatctgcgccgtacatgcgaacaaacgcattcagatattgcagcggctggcgatcttcttcctgtgccagtaataacaacgtttgcaggcagcgataatagttggcgcgttccggactaaatactgatgagttaaactccatcgtccattcggtccagaccagagcctgttccagatcgccaccagccagcgccagcatggcttttaattcaccgatacgcagggtgtaccaaccgttatccgacccggtcgccagacccaacagctcacgcacgcgggtaaagtcatcaaaaccttcttcatccagttgctcgatgaggttcaggtaatcttctttttcccactcgctgcctggtagcgaaagaatcgtttcacgtaaatggctgcccatactgttattcgcgagccacagatcttcagccggataaatatcggacatgccaggcacgataatacggcaagcataaacgcccagatgctcgtaatcggcaatataaacttctttatcttctttgttgaagatagccatcagtgtggcgaactcttcttccgtggtgccggagaaattccagtccacaaacggataatcggcatcctgcttgaacaggtcccaggagattaaaccgctggaatcgataaagtgcgtttcgaggttggtatgttcagcgacttcttcatcatcgaaggttggcggagtaaacacatccaaatctttcaggccacgaccttgcagcagctcggtcacggtacgttccagtgctacgccaaaatcaggatgcgcaccgaaagaggcaaagcaggtaccgttagcaggattgaacagtaccacgcaaatcaccggatactggccgccaagcgaaccgtcataagcgaagattgggaaaccctccgcttccagcgtttcgatggcttcaactactgctgggtaacgcgccagcacgtctgccgggatctctggcaggctgatgctttcagcaataatgcggtttttcacgtagcgttcgaaaacttcagacaatccctgaacgcgtgcttcgttgcgggtattacctgcggacataccgttggagacgtacaggttaccaatgatattcatcggaatataaacggtctgattgtcggactgacgcgtaaacggcaggccgcaaataccacgatcttcgttaccggattgtaggtcaatcagcatgctgccggtcagttcattctccggatcataaaacgcgcgcagacggtcatcgagcagcccttctggcacatcgtcattttcggtcagtgggaaccatttttcgttgggataatgcacgaacggaccgttggcgatggtttcgcccagccagaagtccgcaaaaaagtagttggttgagagacgctcgaaatattcaccgagtgcagaagccagcgccgctttcttggttgcgcctttaccgttggtaaaacacagtgcgcactctttgtcgcgaatatgtacagaccagacgttaggcacgggattcagccaggaggcctcttcaatctgaaagccgaggtctgaaagtttttgctggaagcgagcgatggaatcttccagagcggcatctttgccggggataaatgtttgcgtcatgaaaatcactttagtcgtacggaaagcgcgcaataatacgggttttatctcaaaggcgctatcaccgccgccatgccgatgaactgttgactatgcttttagcggataaaccacgttaagagcataaaaatgaaggcgttcgatctccaccgtatggcatttgataaagtgccttttgatttccttggcgaagttgcactacgtagtctttatacctttgtactggtctttttgttcctcaaaatgaccggaagacgcggtgtgcggcagatgtcgctgtttgaagttttaatcattctgacgctgggatcagcggcgggagatgtggcgttttatgatgatgtgccgatggtcccggtacttatcgtctttattactctggcgttgttataccgcctggtaatgtggttgatggcgcacagtgaaaaactggaagatcttctggaaggcaagccagttgtcattattgaagatggcgagctggcctggtcgaaactcaataactccaacatgacggaatttgagttctttatggagctacgattgcgtggcgtggagcagctggggcaggtacgtctggcgattctcgaaaccaacgggcaaatcagtgtctatttctttgaagatgacaaggtgaaaccgggtttacttattttacccagtgattgtacgcagcgttacaaagtggtgccggagtcggcggactatgcctgtattcgttgtagtgaaatcattcatatgaaagcgggggaaaaacaattatgtccgcgctgtgcaaatccagaatggacgaaggcaagtcgggcaaaacgggtgacctgacagtaaaaacatcggctttttgctaataatccgagagattcttttgtgtgatgcaagccacatttttgccctcaacggttttactcattgcgatgtgtgtcactgaatgataaaaccgatagccacaggaataatgtattacctgtggtcgcaatcgattgaccgcgggttaatagcaacgcaacgtggtgaggggaaatggctcaaatcttcaattttagttctggtccggcaatgctaccggcagaggtgcttaaacaggctcaacaggaactgcgcgactggaacggtcttggtacgtcggtgatggaagtgagtcaccgtggcaaagagttcattcaggttgcagaggaagccgagaaggattttcgcgatcttcttaatgtcccctccaactacaaggtattattctgccatggcggtggtcgcggtcagtttgctgcggtaccgctgaatattctcggtgataaaaccaccgcagattatgttgatgccggttactgggcggcaagtgccattaaagaagcgaaaaaatactgcacgcctaatgtctttgacgccaaagtgactgttgatggtctgcgcgcggttaagccaatgcgtgaatggcaactctctgataatgcggcttatatgcattactgcccgaatgaaaccatcgacggtatcgccatcgacgagacgccagacttcggcaaagatgtggtggtcgccgccgacttctcttcaaccattctttcccgtccgattgacgtcagccgttatggtgtaatttacgctggcgcgcagaaaaatatcggcccggctggcctgacaatcgtcatcgttcgtgaagatttgctgggcaaagcgaatatcgcgtgtccgtcgattctggattattccatcctcaacgataacggctccatgtttaacacgccgccgacatttgcctggtatctatctggtctggtctttaaatggctgaaagcgaacggcggtgtagctgaaatggataaaatcaatcagcaaaaagcagaactgctatatggggtgattgataacagcgatttctaccgcaatgacgtggcgaaagctaaccgttcgcggatgaacgtgccgttccagttggcggacagtgcgcttgacaaattgttccttgaagagtcttttgctgctggccttcatgcactgaaaggtcaccgtgtggtcggcggaatgcgcgcgtctatttataacgccatgccgctggaaggcgttaaagcgctgacagacttcatggttgagttcgaacgccgtcacggctaatgccgaaattttgcttaatccccacagccagcctgtggggtttttatttctgttgtagagagttgagttcatggaatccctgacgttacaacccatcgctcgtgtcgatggcactattaatctgcccggttccaagagcgtttctaaccgcgctttattgctggcggcattagcacacggcaaaacagtattaaccaatctgctggatagcgatgacgtgcgccatatgctgaatgcattaacagggttaggggtaagctatacgctttcagccgatcgtacgcgttgcgaaattatcggtaacggcggtccattacacgcagaaggtgccctggagttgttcctcggtaacgccggaacggcaatgcgtccgctggcggcagctctttgtctgggtagcaatgatattgtgctgaccggtgagccgcgtatgaaagaacgcccgattggtcatctggtggatgctctgcgcctgggcggggcgaagatcacttacctggaacaagaaaattatccgccgttgcgtttacagggcggctttaccggcggcaacgttgacgttgatggctccgtttccagccaattcctcaccgcactgttaatgactgcgcctcttgcgccggaagatacggtgattcgtattaaaggcgatctggtttctaaaccttatatcgacatcacactcaatctgatgaagacgtttggtgttgaaattgaaaatcagcactatcaacaatttgtcgtaaaaggcgggcagtcttatcagtctccgggtacttatttggtcgaaggcgatgcatcttcggcttcttactttctggcagcagcagcaatcaaaggcggcactgtaaaagtgaccggtattggacgtaacagtatgcagggtgatattcgctttgctgatgtgctggaaaaaatgggcgcgaccatttgctggggcgatgattatatttcctgcacgcgtggtgaactgaacgctattgatatggatatgaaccatattcccgatgcggcgatgaccattgccacggcggcgttatttgcaaaaggcaccaccacgctgcgcaatatctataactggcgtgttaaagaaaccgatcgcctgtttgcgatggcaacagaactgcgtaaagtcggtgcggaagtagaagaggggcacgattacattcgtatcactccaccggaaaaactgaactttgccgagatcgcgacatacaatgatcaccggatggcgatgtgtttctcgctggtggcgttgtcagatacaccagtgacgattcttgatcccaaatgcacggccaaaacatttccggattatttcgagcagctggcgcggattagccaggcagcctgaatgaacaacgggcaataaatagccaaatctttctttatcaaaacgtcggcacattgtcggcgttttttttcggaccttgtgagtcattttgattaatggtagcgtcgcttgtcaatgtaagttgttgatacataatatttatatatgattaatcaacggatgattcacatgaagaatactaaattactgctggcgattgcgacctctgcagcattactgacagggtgtcaaaatacccacggtattgataccaatatggctatcagctccggtttaaatgcctataaagcagcaacattaagcgatgccgatgcaaaagcgattgccaatcagggctgtgccgaaatggacagcggcaatcaagtcgcaagtaaatccagcaagtacggtaaacgtctggcaaaaatcgccaaagcattgggtaacaatattaatggcacgccggtcaactataaggtttatatgaccagcgacgtcaacgcatgggcgatggcgaacggctgtgttcgtgtctacagtggcctgatggacatgatgaatgacaacgaaattgaaggcgttctgggccatgaactgggccacgtcgcgttgggtcactcgctggctgaaatgaaagcttcttatgcgatcgttgccgcacgcgatgccatttcagctaccagcggtgtggcttcccagctttcccgctcacaattaggtgatatcgcagaaggcgctatcaatgctaaatactcccgtgataaagagtccgaagcagatgatttctcctttgatctgttgaagaaacgtggcatcagcacccaggggctggttggcagctttgaaaaactggctagcctggatggcggtcgcacccagtccatgtttgactctcacccaccatcaacagagcgtgcgcaacacatccgtgatcgtatcgcctctggtaagtaaatcattgtcatctttcgggctggtcttctgccagcccgctataattgcgcaataaatccccatctgaatacagacaaaactggtttttgcacacaacgttaacgatttgtggcgtcggcgcgtataatgcgcgcggttatgttaacggtacgcctgttttaaggagataaagatgacggcaattgccccggttattaccattgatggcccaagcggtgcagggaaaggcaccttgtgtaaggctatggcggaagcgttgcaatggcatctgctggactcgggtgcaatttatcgcgtactggcattggcggcattacatcaccatgttgatgttgcgtcggaagatgcgctggtaccgctggcatcccatctggatgtacgttttgtgtcgaccaatggcaatctggaagtgatcctcgaaggggaagatgtcagcggcgaaattcgtactcaggaagtggcgaatgcagcttcacaagtcgcggcattcccacgcgttcgtgaagcattattgcgtcgccaacgcgcgtttcgcgaattaccaggtctgattgccgatggccgcgacatgggaacggtggtattccctgatgcaccagtgaaaattttccttgacgcctcctcggaagaacgtgcgcatcgccgcatgctacagttgcaggagaagggctttagtgttaactttgagcgccttttggccgagatcaaagaacgcgacgaccgcgatcgtaaccgagcggtagcgccactggttccggcagccgatgctttagtgttggattccaccaccttaagcattgagcaagtgattgaaaaagcgctacaatacgcgcgccagaaattggctctcgcataagcgaccgaatttgcagtacccccgttgcaatggaatgacagcgggtatgttaaacaaccccatccggcatggagccaggtggacgttaaatataaacctgaagattaaacatgactgaatcttttgctcaactctttgaagagtccttaaaagaaatcgaaacccgcccgggttctatcgttcgtggcgttgttgttgctatcgacaaagacgtagtactggttgacgctggtctgaaatctgagtccgccatcccggctgagcagttcaaaaacgcccagggcgagctggaaatccaggtaggtgacgaagttgacgttgctctggacgcagtagaagacggcttcggtgaaactctgctgtcccgtgagaaagctaaacgtcacgaagcctggatcacgctggaaaaagcttacgaagatgctgaaactgttaccggtgttatcaacggcaaagttaagggcggcttcactgttgagctgaacggtattcgtgcgttcctgccaggttctctggtagacgttcgtccggtgcgtgacactctgcacctggaaggcaaagagcttgaatttaaagtaatcaagctggatcagaagcgcaacaacgttgttgtttctcgtcgtgccgttatcgaatccgaaaacagcgcagagcgcgatcagctgctggaaaacctgcaggaaggcatggaagttaaaggtatcgttaagaacctcactgactacggtgcattcgttgatctgggcggcgttgacggcctgctgcacatcactgacatggcctggaaacgcgttaagcatccgagcgaaatcgtcaacgtgggcgacgaaatcactgttaaagtgctgaagttcgaccgcgaacgtacccgtgtatccctgggcctgaaacagctgggcgaagatccgtgggtagctatcgctaaacgttatccggaaggtaccaaactgactggtcgcgtgaccaacctgaccgactacggctgcttcgttgaaatcgaagaaggcgttgaaggcctggtacacgtttccgaaatggattggaccaacaaaaacatccacccgtccaaagttgttaacgttggcgatgtagtggaagttatggttctggatatcgacgaagaacgtcgtcgtatctccctgggtctgaaacagtgcaaagctaacccgtggcagcagttcgcggaaacccacaacaagggcgaccgtgttgaaggtaaaatcaagtctatcactgacttcggtatcttcatcggcctggacggcggcatcgacggcctggttcacctgtctgacatctcctggaacgttgcaggcgaagaagcagttcgtgaatacaaaaaaggcgacgaaatcgctgcagttgttctgcaggttgacgcagaacgtgaacgtatctccctgggcgttaaacagctcgcagaagatccgttcaacaactgggttgctctgaacaagaaaggcgctatcgtaaccggtaaagtaactgcagttgacgctaaaggcgcaaccgtagaactggctgacggcgttgaaggttacctgcgtgcttctgaagcatcccgtgaccgcgttgaagacgctaccctggttctgagcgttggcgacgaagttgaagctaaattcaccggcgttgatcgtaaaaaccgcgcaatcagcctgtctgttcgtgcgaaagacgaagctgacgagaaagatgcaatcgcaactgttaacaaacaggaagatgcaaacttctccaacaacgcaatggctgaagctttcaaagcagctaaaggcgagtaattctctgactcttcgggatttttattccgaagtttgttgagtttacttgacagattgcaggtttcgtcctgtaatcaagcactaagggcggctacggccgcccttaatcaatgcagcaacagcagccgcttaatttgcctttaaggaaccggaggaatcatgaccaagtcagaattgatagaaagacttgccacccagcaatcgcacattcccgccaagacggttgaagatgcagtaaaagagatgctggagcatatggcctcgactcttgcgcagggcgagcgtattgaaatccgcggtttcggcagtttctctttgcactaccgcgcaccacgtaccggacgtaatccgaagactggcgataaagtagaactggaaggaaaatacgttcctcactttaaacctggtaaagaactgcgcgatcgcgccaatatttacggttaagttttttactcaaacttgaacgagagaaaagcacctgtcgggtgcttttttcatttctctaatctggaactggaagctgcctcgcagagttttgaacagttttcaccctttcgttaaattcttctgaatatgcctcggggaacgcaaaattcccaccagacaaccgctcaacaaagttgcacactttccataaacagggaggggtgcatgaaaataacgacagtcggtgtatgcataattagcggaatttttccgttgctgattttgccccaattgcctgggacattaacccttgcgtttctgactctcttcgcctgcgtactggcatttatccctgttaaaaccgtccgttatatcgcgctgacgttgctgtttttcgtttggggcatattatcagcaaagcaaattttgtgggcaggagaaaccttaactggcgcgacgcaggatgcaattgttgagatcactgcaactgacggcatgaccactcattacggtcaaattactcatctacaaggtcgacgtatattccctgcgtcaggtctcgtgatgtatggcgaatatcttccgcaagcggtttgtgctggacaacaatggtcaatgaaactcaaagttcgtgcagttcatggccaacttaatgatggcggctttgatagccagcgttatgccattgcccagcatcagccgctcaccggccgttttctgcaggcaagtgtcattgaaccgaattgtagcctgcgtgcacagtatctggcgtcactacaaacaacgctgcaaccctatccgtggaatgcggttattcttggtttaggtatgggggaacggttatccgtccccaaagaaatcaaaaatatcatgcgcgatactggaacggcgcatttaatggcgatatcgggattgcacatcgcttttgcggcgttgctggctgccggactcattcgcagtggacaaatttttctgcctgggcgctggatccactggcaaataccattaattggcggaatctgctgtgctgctttttatgcctggttgacgggaatgcaacctcctgcattgcgtaccatggtggcgcttgctacgtggggaatgcttaagttaagtgggcgacagtggagtggctgggatgtatggatatgttgtctggcggcaattttgctgatggatcctgttgccattctctcgcaaagtttatggctctctgccgctgcggtcgcggcattgatattttggtatcagtggtttccctgtcctgagtggcaactgccgccggtattgcgtgcagttgtttccctcatccatctgcaactgggaatcacacttctgcttatgcccgtgcaaatcgtcatatttcatggcattagtctgacctcgtttattgcaaatctattagcaattcccttggtgacatttatcacggttccgttgatcctcgccgcgatggttgtgcatttaagcgggccgttaatcctggagcaagggttatggtttcttgccgaccggtctttggctttacttttctgggggttaaagagtttgccggaagggtggatcaacattgctgaatgttggcaatggctatcattttccccatggttcttactggtggtatggcgattaaacgcctggcgaacgttgccagcaatgtgtgtggctggaggcttgctgatgtgctggccgctgtggcaaaaacctcgacctgacgagtggcagctgtacatgcttgatgtcgggcaagggctggcaatggtgatagccagaaacggcaaagcgattctctatgacacaggactggcctgaaggggatagtgggcaacaactgattatcccctggctccactggcataatcttgaaccggaaggcgttattctgagccatgaacatctggatcaccggggagggctggattcaatattgcatatatggccgatgttatggatcagaagtccgttaaactgggaacatcatcagccctgtgtgcgtggcgaagcgtggcaatggcaaggattgcgtttcagcgcgcactggcctttacaaggtagcaacgataaaggaaataaccattcctgtgtggttaaggttgatgacgggacgaatagcattcttctaaccggtgatattgaagccccagctgaacaaaagatgctaagccgttactggcagcaagtgcaggcaacattgcttcaggtacctcaccatggcagtaatacctcatcatcgttgccattaattcagcgagtgaatggaaaagtggcactcgcatcggcatcgcgctataacgcatggcgactgccctctaacaaagttaagcatcgctatcaactgcaaggatatcaatggattgatactccacatcaaggtcaaacaacggtcaatttttcagcgcaaggctggcggattagcagcctcagggagcaaattttacctcgttggtatcatcagtggtttggcgtgccagtggataacgggtagaatatgcggctatttcaacaaatgctggttttttgaatgcataacgacaaagatctctctacgtggcagacattccgccgactgtggccaaccattgcgcctttcaaagcgggtctgatcgtggcgggcgtagcgttaatcctcaacgcagccagcgataccttcatgttatcgctccttaagccacttcttgatgatggctttggtaaaacagatcgctccgtgctggtgtggatgccgctggtggtgatcgggctgatgattttacgtggtatcaccagctatgtctccagctactgtatctcctgggtatcaggaaaggtggtaatgaccatgcgtcgccgcctgtttggtcacatgatgggaatgccagtttcattctttgacaaacagtcaacgggtacgctgttgtcacgtattacctacgattccgaacaggttgcttcttcttcttccggcgcactgattactgttgtgcgtgaaggtgcgtcgatcatcggcctgttcatcatgatgttctattacagttggcaactgtcgatcattttgattgtgctggcaccgattgtttcgattgcgattcgcgttgtatcgaagcgttttcgcaacatcagtaaaaacatgcagaacaccatggggcaggtgaccaccagcgcagaacaaatgctgaagggccacaaagaagtattgattttcggtggtcaggaagtggaaacgaaacgctttgataaagtcagcaaccgaatgcgtcttcaggggatgaaaatggtttcagcctcttccatctctgatccgatcattcagctgatcgcctctttggcgctggcgtttgttctgtatgcggcgagcttcccaagtgtcatggatagcctgactgccggtacgattaccgttgttttctcttcaatgattgcactgatgcgtccgctgaaatcgctgaccaacgttaacgcccagttccagcgcggtatggcggcttgtcagacgctgtttaccattctggacagtgagcaggagaaagatgaaggtaagcgcgtgatcgagcgtgcgactggcgacgtggaattccgcaatgtcacctttacttatccgggacgtgacgtacctgcattgcgtaacatcaacctgaaaattccggcagggaagacggttgctctggttggacgctctggttcgggtaaatcaaccatcgccagcctgatcacgcgtttttacgatattgatgaaggcgaaatcctgatggatggtcacgatctgcgcgagtataccctggcgtcgttacgtaaccaggttgctctggtgtcgcagaatgtccatctgtttaacgatacggttgctaacaacattgcttacgcacggactgaacagtacagccgtgagcaaattgaagaagcggcgcgtatggcctacgccatggacttcatcaataagatggataacggtctcgatacagtgattggtgaaaacggcgtgctgctctctggcggtcagcgtcagcgtattgctatcgctcgagccttgttgcgtgatagcccgattctgattctggacgaagctacctcggctctggataccgaatccgaacgtgcgattcaggcggcactggatgagttgcagaaaaaccgtacctctctggtgattgcccaccgcttgtctaccattgaaaaggcagacgaaatcgtggtcgtcgaggatggtgtcattgtggaacgcggtacgcataacgatttgcttgagcaccgcggcgtttacgcgcaacttcacaaaatgcagtttggccaatgatcgaaaaaatctggtctggtgaatcccctttgtggcggctattgctgccactctcctggttgtatggcctggtgagtggcgcgatccgtctttgctataaactaaaactgaagcgcgcctggcgtgcccccgtaccggttgtcgtggttggtaatctcaccgcaggcggcaacggaaaaaccccggtcgttgtctggctggtggaacagttgcaacagcgcggtattcgcgtgggggtcgtatcgcggggatatggtggtaaggctgaatcttatccgctgttattgtcggcagataccacaacagcacaggcgggtgatgaacctgtgttgatttatcaacgcactgatgcgcctgttgcggtttctcccgttcgttctgatgcggtaaaagccattctggcgcaacaccctgatgtgcagatcatcgtaaccgacgacggtttacagcattaccgtctggcgcgtgatgtggaaattgtcgttattgatggtgtgcgtcgctttggcaatggctggtggttgccggcggggccaatgcgtgagcgagcggggcgcttaaagtcggttgatgcggtaatcgtcaacggcggtgtccctcgcagcggtgaaatccccatgcatctgctgccgggtcaggcggtgaatttacgtaccggtacgcgttgtgacgttgctcagcttgaacatgtagtggcgatggcggggattgggcatccgccgcgcttttttgccacgctgaagatgtgtggcgtacaaccggaaaaatgtgtaccgctggccgatcatcagtctttgaaccatgcggatgtcagtgcgttggtaagcgccgggcaaacgctggtaatgactgaaaaagatgcggtgaaatgccgggcctttgcagaagaaaattggtggtatttgcctgtagacgcacagctttcaggtgatgaaccagcgaaactgcttacgcaactaacctcgctggcttctggcaactagttacgccgcggcagcgttcgattgatggagtcatgaatgtcgctgccgcacctctcccttgctgatgcgcgtaatcttcaccttgccgcacaaggcctgttaaacaaaccccgccgtcgagcgtcgttggaggatattccggcaacgatctcccgcatgtccttgctgcaaatcgataccatcaatattgttgcccgtagtccatatctggtgcttttcagtcgtctgggaaattatcctgcccagtggctggatgagtctctggcgcgtggcgaattaatggaatactgggcgcatgaagcctgctttatgccgcgtagcgactttcgtcttattcgccaccgcatgctggcacctgaaaaaatgggctggaaatacaaagacgcctggatgcaggaacatgaggcggaaattgcacagttaattcagcatattcatgataaggggccggtacgttcagccgattttgagcatcctcgtaaaggtgcaagcggctggtgggaatggaagccgcataaacggcatctggaaggtttatttactgccggaaaggtgatggtgattgaacggcgcaacttccagcgcgtttatgatttaacccaccgtgtcatgcctgactgggatgatgagcgcgatctcgtttcgcaaacagaagcagaaatcatcatgctggataacagtgcgcgtagcctgggaatattccgcgaacagtggctggcagattactatcggctgaaacgtccggcactggcggcgtggcgcgaagcgagggctgaacagcagcaaatcattgctgtgcatgttgaaaaattgggcaatctttggctgcatgatgatttgctgccgctactcgagcgagcgctggccggaaagctcactgcaacgcacagcgcggtactttcgccttttgatcctgttgtctgggatcgcaaacgcgcagagcagctttttgattttagctaccggctggagtgctataccccagcgccgaaacgccagtatggctattttgttctgccgttattacatcgtgggcaattagttgggcgaatggatgccaaaatgcatcgccagacaggcatccttgaagttatctctctgtggttacaggaaggtattaaaccaacgacaacgctgcaaaaagggctacgtcaggcgattactgatttcgctaactggcagcaggcaacgcgggtgacattaggatgctgcccgcaaggcctctttactgattgccgcaccggctgggaaatagaccccgtcgcataaatgattatgataagatttatgcattcataacccgatccatctggaggaactatggatcatcgtctgcttgaaatcattgcctgcccggtttgcaacggaaaactttggtataaccaggaaaaacaagagcttatttgcaaactggacaacctcgctttcccgctgcgtgatggcattccagtgttgctggaaacggaagcccgcgtgctgactgctgatgagagtaaatcatgagttttgtggtcattattcccgcgcgctacgcgtccacgcgtctgcccggtaaaccattggttgatattaacggcaaacccatgattgttcatgttcttgaacgcgcgcgtgaatcaggtgccgagcgcatcatcgtggcaaccgatcatgaggatgttgcccgcgccgttgaagccgctggcggtgaagtatgtatgacgcgcgccgatcatcagtcaggaacagaacgtctggcggaagttgtcgaaaaatgcgcattcagcgacgacacggtgatcgttaatgtgcagggtgatgaaccgatgatccctgcgacaatcattcgtcaggttgctgataacctcgctcagcgtcaggtgggtatggcgactctggcggtgccaatccacaatgcggaagaagcgtttaacccgaatgcggtgaaagtggttctcgacgctgaagggtatgcactgtacttctctcgcgccaccattccttgggatcgtgatcgttttgcagaaggccttgaaaccgttggcgataacttcctgcgtcatcttggtatttatggctaccgtgcaggctttatccgtcgttacgtcaactggcagccaagtccgttagaacacatcgaaatgttagagcagcttcgtgttctgtggtacggcgaaaaaatccatgttgctgttgctcaggaagttcctggcacaggtgtggatacccctgaagatcttgagcgcgttcgcgctgaaatgcgctaatttcacttcacgacacttcagccaattttgggaggagtgtcgtaccgttacgattttcctcaatttttcttttcaacaattgatctcattcaggtgacatcttttatattggcgctcattatgaaagcagtagcttttatgagggtaatctgaatggaacagctgcgtgccgaattaagccatttactgggcgaaaaactcagtcgtattgagtgcgtcaatgaaaaagcggatacggcgttgtgggctttgtatgacagccagggaaacccaatgccgttaatggcaagaagctttagtacgcccggaaaagcccgacaactggcatggaaaaccaccatgctggcaagaagtgggactgtccgtatgccgactatttatggtgtgatgacgcatgaagaacaccccggccccgatgtcctgctactggagcggatgcgtggtgtttcggtggaggcaccagcccgaacaccagaacgctgggaacaactcaaagaccaaatcgttgaagccttactggcctggcaccgtcaggacagtcgcggttgcgtcggcgcggtcgacaatactcaggaaaatttctggccctcatggtaccggcaacatgttgaagtgctatggaccacgctcaatcagttcaataacaccggtctgacgatgcaggataagcggatcctgtttcgcactcgcgaatgtctcccggcattatttgaaggctttaacgacaattgtgtgctgattcacggtaacttctgtttacgcagcatgttgaaagattcgcgcagcgatcagttactggcgatggtcgggccgggactaatgctttgggcaccgcgagaatacgaactgttccgactaatggataattctctggcggaagatttgctctggagttacctgcaacgcgcgccagtggcggagtcgttcatctggcggcgttggttgtatgtgttatgggatgaagttgcgcaactggttaataccggacgatttagtcggcgcaacttcgatctggcatcaaaatcactcttgccgtggctcgcctgacgaaccttttagccactgccagatacggccaagcgtttcatagccaacacgatcgctatgcatcaaccagaccggagaagggattgcccgttcccacgggttaagcggcgagtcgatggccaactgattcgccggggctggtagcggatttaacccttcctgctgaaaaaagatcatcgcccgcggcagatgtgatgcggaggtcaccagcaggaaaggggcgtcaccaatcgcctgtttcactgctgcagcttcttcttcggtatcttttggcaaatccagggtgataatttgctcgcgcggcacgcccagcgattgcgcaactctggcacctacttccgctgtactcaccgtattggtttttgctacgcctcccgtgaagatcagttttgatcccggattttcgcgccataagcgaataccttcattcaggcgtggcagactgttattgattaaattagagctcggtgcccactgcgggttccaggtataaccacctccgagcaccacgatatagtccactttttgcgaattattccatgtcggataggtgctttcgatgggacgcagcaggcggtcggctaccggttgcaaactcaataacaagagcgccagccacccaatgctaataaaaatcttcccggttttttgaaaacggctaaaccacagcagcgccaggccagcgccaataatcaacaacatcagcggaagtggcagcaacatattgccaatcacttttttcagtgtaaaaagcatcctttctggttccttttttaaccatatagcaagggatcgccagcgatattacaccagacgggttcattctcgccgtggctgtgacaaaatagcgtctttatcagaaaacgtcttagccaaccggtggagaaagcaatgcaggatcgcaattttgatgatattgcggaaaagttttcccgtaacatttacggcaccaccaaagggcagcttcgacaggctattctgtggcaggatctcgatcgcgtgctggcggaaatgggcccgcaaaaactgcgtgtgctggatgctggcggtggagaagggcagaccgcaatcaaaatggccgagcgtgggcatcaggtcattttatgcgatctttctgcgcagatgatcgaccgcgcaaaacaggcggcagaagcaaaaggtgtgagcgacaacatgcaatttatacattgcgccgctcaggatgttgcttcgcatttggaaacgcccgttgatctgatattgttccatgcggtgctcgagtgggtggctgatccccgcagcgtattgcagaccctgtggtcagtgttgcgtccaggcggcgtgttgtcgttaatgttctacaatgcgcatggtttgttgatgcataacatggtcgccgggaattttgattacgtgcaggcgggaatgccgaaaaagaaaaaacggacgctttcgccagattatccacgcgacccggcgcaggtttatctgtggctggaagaagctggttggcaaattatgggtaagacaggcgttcgcgtgtttcatgattatctgcgcgagaaacaccagcagcgcgactgctatgaagcattacttgaattagaaacgcgttattgccgtcaggaaccgtatattaccctggggcgttatattcatgtcaccgcgcgcaaaccgcagagcaaggataaagtatgagtgaattttcccagacagtccccgaactggttgcctgggccagaaaaaatgacttctccatctcgctgccggtagaccgactctcttttctgctggcggttgccacgctgaacggcgagcgtctggatggtgagatgagtgaaggcgagctggtggatgcattccgccatgtgagtgatgcgtttgagcaaaccagcgaaaccatcggcgtgcgcgccaataacgcgatcaacgacatggtgcgtcaacgtctgctgaaccgctttaccagcgagcaggcggaagggaacgcaatttaccgtctgacgccgctcggcatcggcattactgactactacatccgtcagcgcgagttttctacgctgcgtctttctatgcagttgtcgattgtggcgggtgagctcaaacgcgcagcagatgccgccgaagagggcggtgatgaatttcactggcaccgtaatgtctatgcgccactgaaatattcggtagcagaaattttcgacagtatcgacctgacgcaacgtctgatggacgaacagcagcagcaggtgaaggacgatatcgcccagttgctgaacaaagactggcgggcggcgatttccagctgtgaattgttgctttcggaaacttccggaacgctgcgtgaattgcaggatacgctggaagcggcaggcgacaaattgcaggctaatctgttgcgcattcaggatgcgacgatgacccatgacgatctgcatttcgtcgatcgtctggtgttcgatctgcagagcaaactcgatcgtattatcagttggggccagcaatccatcgacttgtggattggctacgaccgccacgtacacaaatttattcgtaccgcgatcgatatggataaaaaccgcgtctttgctcagcggttacgtcagtcggtacaaacctattttgatgagccgtgggcgctaacttatgccaatgccgatcgtctgctggatatgcgtgacgaagagatggcactgcgcgatgaagaagtgactggggaacttcctgaggatctggaatacgaagagtttaacaagatccgcgaacagctggcggcgatcatcgaagaacaacttgccgtgtacaaaaccagacaagtgccgctggatcttggtctggtggtacgcgaatatctgtcacagtatccgcgtgcacgtcactttgacgttgcgcgtattgttattgatcaggcggtacgtcttggcgtagcgcaagcagatttcaccggactgccagcgaaatggcagccgattaatgattacggagccaaggtacaggcgcatgtcatcgacaaatattgaacaagtgatgccggttaagctggcgcaggcgctggcgaatccgttatttccggcgctggacagcgccttacgttcaggccgccatattggcctcgacgaactggataatcatgcattcctgatggattttcaggaatatctggaagagttttacgcgcgttataacgttgagcttattcgcgcaccggaagggttcttctatttacgcccacgttccaccactcttatcccgcgttccgtcttgtcggaactggatatgatggtcgggaaaatcctctgttatctctatctcagcccggaacggctggcgaatgaggggattttcacccagcaggaactgtacgacgaactgctcaccctggccgatgaagcaaaactgctgaaactggtgaacaaccgttcaaccggttcagacgttgaccgtcagaagttgcaggagaaagtacgttcttcgctcaaccgtctgcgtcgtttaggcatggtgtggtttatgggccacgacagcagcaagtttcgcattaccgaatcggtgttccgcttcggagccgatgtgcgtgctggcgacgatccccgtgaagcacagcgtcgcctgattcgtgatggcgaagcaatgccgattgaaaatcatctgcaactcaacgatgaaaccgaagagaatcagccagatagcggagaggaagaataatgattgaacgcggtaaatttcgctcactgacgctgattaactggaacggcttttttgcccgaacttttgaccttgacgagctggtcacgacgctttctggcggtaacggggcgggtaaatccaccaccatggcggcgttcgttacggcgctgatccccgacctgaccctgctgcatttccgtaacactacggaagccggggccaccagcggttcgcgcgataaaggtctgcacggtaagctgaaagcgggtgtctgttattcgatgctcgacaccattaactcgcgccaccagcgcgtggtggtcggtgtgcgtctgcaacaggttgccggacgcgatcgtaaagtggatatcaaaccatttgccattcagggactgccgatgtcggtgcagccgacacagctggtgaccgaaaccctgaacgaacgccaggcgcgcgtgctgccgcttaacgagctgaaagacaagctcgaggcgatggaaggcgtgcagtttaaacagttcaactccattaccgattaccactcgctgatgttcgatctgggcatcatcgcgcgtcgtctgcgctccgcatctgaccgtagcaaattctatcgtctgatcgaagcttcgctgtatggcgggatctccagtgccattacccgttctctgcgcgactacctgttgccggaaaacagcggcgtgcgtaaagcgttccaggacatggaagcggcgctgcgtgaaaaccgcatgacgctggaagcgattcgtgtcacccagtcggaccgtgacctgtttaagcatctgatcagcgaagctaccaactacgtggcggcggactacatgcgtcacgccaacgagcgccgtgtccatctcgacaaagccctggagtttcgtcgcgagttacatacttcgcgtcagcaactggcggctgagcagtacaaacacgtcgatatggcgcgtgagctggcagagcacaacggtgccgaaggcgatctggaagcggattatcaggcggccagcgatcacctgaacctggtgcaaaccgcactgcgtcagcaggagaagatcgaacgctacgaagcggatctcgatgagctgcagatccgtctggaagagcaaaacgaagtggtggcagaagccatcgaacgccaggaagagaacgaggctcgcgcggaagctgccgaactggaagtggacgagctgaaaagccagcttgctgactaccagcaggcgctggacgtccagcaaacgcgcgcgatccagtataaccaggcgattgctgcacttaatcgtgccaaagaactgtgccatctgccggacttaaccgccgacagcgccgccgaatggctggaaaccttccaggcgaaagagctggaagcgactgaaaaaatgctctctcttgagcagaaaatgagcatggcgcaaaccgcgcacagccagtttgagcaggcttatcagctggtggtggcaatcaacggcccactggcgcgtaacgaggcgtgggatgtcgctcgcgaactattgcgcgaaggggtcgatcagcgtcacctggcagagcaggttcagccgctgcggatgcgattaagcgaactggaacagcgtctacgcgagcagcaagaagctgagcgtctgctggcagatttctgcaaacgtcagggcaagaattttgatatcgacgaactggaagccctgcatcaggaactggaagcacgcattgcctctctttccgatagcgtgtctaacgcccgtgaagagcgcatggcactgcgccaggagcaggaacagctgcagtctcgcattcagagtttgatgcagcgtgcgccggtttggctggcagcgcaaaacagtctcaaccagttgagcgaacagtgcggcgaagagtttacctccagccaggacgtcaccgaatatctgcaacagttgctggagcgtgagcgagaggcgattgttgaacgcgatgaagtgggcgcgcgcaaaaacgccgtcgatgaagagatcgaacgtttaagccagcctggcggctctgaagatcagcgtctgaacgcgctggcggagcgttttggtggtgtgctgctgtcagaaatttatgacgacgttagcctggaagatgcgccgtacttctcagcgctgtatggcccgtcacgccacgccatcgtggtgccagatctgtcacaggtaactgaacacctggaaggcttgaccgattgcccggaagatctctatctgatcgaaggagatccgcagtcattcgatgacagcgtgttcagcgttgatgagctggaaaaagcggtagtggtgaaaatcgccgatcgtcagtggcgttattcacgtttcccggaagtgccgctgtttggtcgtgctgcgcgtgaaagccgtattgaaagcctccatgccgagcgtgaagtgctttccgaacgcttcgccacgctctcctttgatgtacagaaaactcagcgtctgcatcaggcgttcagccgctttatcggcagtcatctggcggttgcgtttgagtctgacccggaagcagaaatccgtcaactgaacagccgtcgcgtcgaactggagcgggcgttaagtaatcatgaaaatgataaccagcagcagcgtattcagtttgagcaggcgaaagagggcgttacggcgctgaaccgcattctgccgcgtctcaacctgttggctgatgacagcctggcggatcgcgtcgatgaaatccgcgaacgtctggatgaagcccaggaagccgcgcgttttgttcagcagtttggcaatcaactggcgaaactggaaccgattgtttcggtattgcagagcgacccggaacagttcgaacagttaaaagaagattacgcgtactctcagcagatgcagcgcgatgcccgtcagcaggcgtttgccctgacggaagtggtgcagcgtcgtgcgcactttagctattctgactcggcagaaatgcttagcggtaacagcgatctcaacgaaaaactgcgtgaacgtctggaacaggcggaagcggagcgtacccgcgctcgcgaagcgttgcgcggtcacgcagcgcagttgagtcagtacaaccaggtgctggcttcgctgaaaagttcttacgacaccaaaaaagagctactcaacgatctgcaacgtgaattgcaggatatcggcgtgcgtgctgatagcggggcagaagagcgggcgcgtattcgccgtgacgagctgcatgcgcaactgagcaataaccgttcacgccgcaatcaactggaaaaagcgcttaccttctgcgaagcggagatggacaacctgacccgcaaactgcgcaagctggagcgggattactttgagatgcgcgagcaggtagtgaccgccaaagcgggctggtgtgcggtgatgcgcatggtgaaagataacggcgttgagcgccgcttacaccgtcgtgagctggcttatctctccgctgatgatttgcgttccatgtcggataaggcgttaggtgcgctgcgtctggcggtggcggataacgaacatctgcgcgacgtgctgcgcatgtcggaagatccgaaacgtccggagcgtaaaattcagttcttcgtggcggtttatcagcatctgcgtgaacgtattcgtcaggatattattcgtaccgatgatccggtggaagctatcgaacagatggagattgaacttagccgtctgaccgaagaattaacctcccgtgaacagaaactggcgatcagttcccgcagcgtggcgaacatcattcgcaaaaccattcagcgcgagcagaaccgtatccgtatgctcaaccaggggttgcagaacgtatcgtttggtcaggtgaacagcgtgcgtctcaacgtgaacgtgcgtgaaacgcacgccatgctactggatgtgctctctgaacagcacgagcagcatcaggatctgtttaacagcaaccgtttgaccttctcggaagcgctggcgaaactgtatcaacgtcttaacccgcagattgatatggggcagcgcacgccgcagaccatcggtgaagaactgctggattaccgcaactatctggaaatggaagttgaggttaaccgtggttccgatggctggctgcgcgcagagtctggtgcattgtcgaccggtgaggcgattggtaccggtatgtcgattctggtgatggtggtacaaagctgggaagatgaatctcgccgcctgcgcggtaaagatatctctccttgccgcctgctgttcctcgatgaagcagcgcgactggatgctcgttctatcgccacgctgtttgaattgtgtgagcgtttgcaaatgcaactcatcatcgcagcgccggaaaatatcagcccggagaaaggcaccacctataaactggtgcgtaaagtcttcctgaataccgaacacgttcatgtcgtcggcctgcgaggatttgcgccgcaactccctgaaacgcttccaggaactgacgaagcgccttctcaggcgagttaaaattaaggcggcagcaatgccgccttttctttttccgaaaactccgtttctgcactaaaaaagtggcacattacggcgcgcttttctttaaacttctttacattaggttatgtaaaaacgtatcggcgtttatatactgaagataagcctgatgagtaacaggcttgctcgtcatactttcgtgagtattggcgttgtacaggcaagtcgtaaaataacagcctggctattcagagtatgataaaaacagggggcaagggatgttgcttaatatgatgtgtggtcgtcggctgtcggcaatcagtttgtgcctggccgtaacattcgctccactgttcaatgcgcaggccgatgagcctgaagtaatccctggcgacagcccggtggctgtcagtgaacagggcgaggcactgccgcaggcgcaagccacggcaataatggcggggatccagccattgcctgaaggtgcggcagaaaaagcccgcacgcaaatcgaatctcaattacccgcaggttacaagccggtttatcttaaccagcttcaactgttgtatgccgcacgcgatatgcaacccatgtgggaaaaccgtgatgctgttaaagccttccagcaacagctggcagaggtggcgattgccggtttccagccgcagtttaataaatgggtagagttactgaccgatcctggtgttaacgggatggcacgcgacgtggtgctctctgatgcgatgatgggctatctccatttcattgcaaatattccggtcaaaggcactcgctggctatatagcagtaaaccttatgcacttgcaacgccgccgctctcggtgattaaccaatggcagctggcgctggataaaggtcaattgcctacgtttgttgcaggactggcaccgcagcatccgcaatatgcggcgatgcatgaatcgttactggccttactctgtgacaccaaaccgtggccccaactgaccggcaaagcaacgttgcgcccagggcagtggagtaacgacgtaccggcgttgcgcgaaatattgcaacgcacaggcatgttggacggggggccgaaaattactctacctggcgatgacacgccaactgacgcggtagtcagcccatccgctgttactgttgaaacagcagaaactaagccgatggataagcaaacgacgtctcgtagtaaacctgcgcctgccgttcgcgccgcctacgataatgaactggtggaagccgttaaacgttttcaggcatggcaaggattgggggcagatggtgctattggcccggcaacacgtgactggttaaacgtaacgcccgcccagcgtgctggcgtgttggctctcaacatccagcgattgcgcttgctgccaacagagctttctaccgggatcatggttaacattccggcctattcgctggtctactatcagaacggcaatcaggtgctggattcgcgagtcattgtcggtcgccccgatcgcaaaacgccgatgatgagcagtgcccttaacaacgtagtggtaaacccgccgtggaacgtacctccaactctggcacgcaaagatattctgccaaaagtgcgcaacgatccgggatatctcgaaagccatggctatacggtgatgcgcggctggaacagcagagaagcgattgacccatggcaggttgactggtctacaatcacggcctcgaatttaccgttccgcttccagcaggctccaggcccacggaactcgctggggcgctataaattcaatatgccgagttcagaggccatttatttgcatgacacgccgaaccacaatctgttcaagcgtgatacacgcgcattgagctcaggctgtgtacgagtgaataaagcttccgatctggcgaatatgctgttgcaggatgcaggctggaatgacaaacgtatttctgatgcgctgaagcagggtgatacacgttacgtcaatattcggcagtcgattccggtgaatctctactacctgacggcctttgttggtgcagatggtcgtacccagtatcgtacagatatttacaattatgatctgcctgcgcgatccagctcgcaaatcgtatcgaaagcggaacaattaatcaggtaaatgaagtagttcggggaaatcagttgtcgtaataattagcatgattgggggcgattctctgcagcccccgtcactgctggggttgagtcatcttgacgtctgctttacgggcggttaaggtgcctcttgtgcgccagaagtgcatataaacgataacattgacctgtagacttgattatcatggacaaattcgacgctaatcgccgcaaattgctggcgcttggtggcgttgcactcggtgccgccatcctgccgacccctgcgtttgcaacactctctaccccacgcccgcgcattttgacactcaataatcttcataccggagagtcaatcaaagcggagtttttcgatggcagaggctatattcaggaagaattggcaaaacttaaccattttttccgcgattaccgcgcgaacaaaataaagtccatcgacccaggattattcgaccagttgtatcgcctgcaagggttgttaggcacgcgcaaaccggtgcaactcatttccggttatcgttctattgataccaacaatgaactacgcgcccgcagccgtggagtagcgaagaaaagctatcacactaaaggccaggcgatggatttccatattgaaggtatcgcgttaagcaatattcgcaaagccgcgttatctatgcgcgcaggtggtgtaggatattacccacgtagtaactttgtgcatattgataccgggccagcacggcactggtagcaatcgcttaacgaaacaggggcagtatgaactatcgtattattccggtcaccgcattctcccagaactgttcattaatctggtgtgaacaaacccgtctggccgcactggtcgatcctggcggcgatgcggaaaaaatcaaacaggaagttgatgacagcggcctgacactgatgcagatcctgctgacgcatggtcatctggaccacgttggcgcagcggcggaactggcgcaacattacggcgtgccagtttttggcccggaaaaagaagatgagttctggctgcaaggcttgcctgcgcaaagtcgtatgtttggtctggaagagtgccagccgctgacgccagatcgttggctgaacgaaggcgataccatcagcatagggaatgtgactttacaggtgttacattgccctgggcatacgccgggtcatgtagtgttttttgatgatcgggcaaagctgctgatttctggcgatgttattttcaaaggcggagtagggcgcagtgacttcccgcgtggcgatcataatcaactgatttcttcaatcaaagataaattgctgccactgggggatgacgtgacatttattccgggtcacggaccattatccacacttggttatgaacgcctgcataatcccttcctgcaagacgaaatgcccgtctggtaaggcacataaaaaagcccgcttttaatgcgggcctggatttctggcaaagtgcgctttgtttatgccggatgcggcacgagcgccttatccggcctacaaaatcgtgcaaattcaaaatattgcaggggacgcgtagatactgttatggcctgcaagttttttcctggtccggtttcccggattgcaggcatgccagacacagcgccgtcaggcgctgtttttttcatcccttccgcgatttttacgccgctaccggattatgccgtgacgcatcgaacggcacgcctgacttcagcactccatacgccacctgtgccagcttgcgcatcatcgcgccgagaatcacctttcctttcttgccattagccgccagacggtcgcggaacgcccgtccccactcagtcttactggtggctaccattgcgggcatatacaacgccctgcgaagcgacacatgtccggccttactcatccggctcgcccctctcacactgctacctgattcataacgccgtggtgtcagacccgcaaaagcggcgaactgtctggcatgggcgaagcggtccttcagaccgatataagccagcaataccgcagatgttttctctccgatacccgggatgctttccagcagtttcctgcggtgtttcatatccggatcatcgtctgtcaggtcttttatctgcttctcaagacgcttcagctctgcttcaagccacagaaggtgagcatcaatgctcggtctctggacttcccgcgccgtttcagtgcgattcagttcctgcgtgtgcatatctgtcagcgcctggtggcggactaccagggcacgcaacgcgcgttcaagcgggtgaggcgcttcccaggctgcagggcgcttctgacgacagaactctgccagcatgcgcgcatccacggtatcagtcttgttacgcagtccttcactctgagcgaaagctttacccagcgcaggattaatgactgacactatgtagccagcatcgtaaaggcactcagcgacaggttccatataggtgccggtcgcttcgatgcagatatgcgcatggtcaatcttgtgacctttcagccagctcaccagctcatcgtgccctttagtggtgttagcgaattttttggtgcgatgacgaccatcaggacgcaacacatcgacatccagtttctctttagcggtgtcgataccgatataatgaagttcatgttccatagtgaaaccaaccttgcaaatacggattaccgggaaaaccggtccatgatactgtccggtttatcactttgggagaaaggcagtccgctgcataaatctacgcaacaggttagaacccaaggcccgatacggcatgcggactgcaggcagagaaaactggccgattttctctgcactggagggataatacaaggcctgataagcgtagcgcatcaggcaatgttgcgtttgtcatcagtctcagcccgcttttcagcgggcttcattgtttttaatgcttacagcactgccacaatcgcttcgcacagcggagccatgttatctggtgtcatcccggccacatttacgcgaccagaagcaaccgcatatacgccaaactcttcgcgcagacgcagcacttgttcttttgtcaggccactgaaggagaacatgccgttctgtttgatgataaagctgaagtcgcggtttgcgcctttttcctgcagcgtattgacgaacaactgacgcatacgctgaatacgctggcgcatatcagtcagctcttgttcccaaatcgcacgtaacgcatcgttgctcaggatggtggcaacaacagaagcgccgtgtgctggtgggttagagtagttagcgcgaatcgccgctttcatttggctgaatgcgcgatcaacggtttcactgtcggcagcaaccagagtacaagcgccaacacgctcgttgtacaggccaaagtttttagagtaggaactggcaacaatcagctctttatgcatagccgcgaaagcgcgcagtccttcagcatcttcttccagaccacgggcaaaaccctggtaagcgaagtcaaacagcggtaaccagcctttctcaacggagagttgtgccagtgtctgccattgttccagcgtagggtcgataccggttgggttatggcagcagccatggaacagcactacgtcgccagcctgagcttcattcaggctgttaatcagtgcatcgaagtcaagagtgtgattttccgcatcataataagcgtattcacgaacttccagacctgcagagttaaagacgctcttatggttcggccagcttgggttgctcacccacactcgcttaacgctggtattttttgccaggaaatcggcagctacgcgtagtgcgccagtgccccccggagtctgtgccgtgcgagcacgtttgtcattgatcagggcgctacctttaccaaacagcagttcctgagtgcagcgaccaaattcagggatgccgtcaatgccgaggtaatttttggtggtttcattttcgagcagatactgttcagcctttttcacgctggtcagtaccggggttttgcccgtctcatctttatagacaccaatcccgaggttaattttgccgggacgttcatcggcacgaaacagatcggccaggcccagaatcgggtcggcaggagcggcggtaatgttctcaaacatgacgaggttccattatggttacagaagggaagtccgctatcagggtaacgggagatttacaaaattccaactattactgatgaaaactcaggctgtttttgcaagacgtgagattgctctggaaggtataaaaaaaacaggaccaacgtcctgttttttcggcatttaacaaagaggtgtgctattagaactggtaaacgatacccacagcaacggtgtcgtctgaacctacgcccagtttgttgtcagaatcgatctggttgatgatgtagtcaacataggtggacatgtttttgttgaagtagtaggttgcgcccacttcaaagtagttcaccagatcaacatcaccgataccttctacgtctttcgctttagatttggtgtaagcgatggacggacgcagaccgaaatcgaactggtattgcgcaactaacagaacgtcttgcgttttgttggcgaagccgctggtgtttgtaaatttattagtgatcggcgtagcgttacgggtttcaccgtagttcgctgccaggtagatgttgttcgcgtcgtacttcagaccagtagcccactgttcagcttttttaccgttgccaagaggttgagcttcttgcaggttggtacggtcagctgcaccataagcaccaacgataccaaagccttcgtattcgtagctgatagaaccgccaacaccgtcgccgttagagcggcgtgcagtgtcacgctcgtttttacccaggtactgaacagcgaagttcaggccatcaaccagaccaaagaagttggagttacgataggtagcaacgccgccaacacgaccaacgaagaagtcatcgctgtatgcagtatcaccaccaaattctggcagcatatcggtgtaacccagtgcatcataaaccacaccgtagttacggccgtaatcgaaagaaccaatgtcagcgtatttaagacccgcgaatgccagacgcgttttgttaccagtttgagcgtcagcgccttcagagttgttaccctggaagttatattcccactgaccataaccggtcagatcggaattgatttgtgtttcccctttaaaaccaagacgggcataagttttgtcgccgtttccgccgtaactgtttacaccattgtctttagaaaaataatgcagaccgacagctttaccgtacagatctactttgttgccatctttgttatagatttctgcagcgtttgcagtacctgctactaacagagcagggacgatcactgccagaatattgcgcttcatcattatttattaccctcatggttttttttatgacacctgccactgccgtcaataagttctgtcaataaaaatttacggaactattgatgagagtttggtgtctttatgtgtctgcaggcatctttccattcaaactaacgtttcgctaccgtgaaagtgctacaaagataaagatttggtttcaaaaagaaaaaatatgtaaccaaaagtaaaatttaaggaactttgtgaacaccgtcatatttccatagaagcgtgatgatatttacagcaatttttatctatttatatgatttccttatatttaaattaactaaacggaaattttgtttctgatggaaactttatcgacctggcactaaatcctcgttcagacatccagaatgccaaaaaatagtatgaaaattgtgctatcagctaagaaaaaactaatccgcaataagaatccaggttattttttgtgcgtaaatgttgcaatgtaatattccgtaacaggatgatcgttatggcggggttgcaaatagattgcttgacttaacaaacagataacttgacagaaaggataaaaaagagccagcaggcgctggctctttgaggaagaaaatcagaagctggcgttgcgcggagtacgtgggaacggaatcacatcacgcacgttttgcacgccagttacgtaagcaatcaggcgttcaaaaccaagaccgaaaccggaatgcggaacagtaccgtagcgacgcagatcgcgataccaccagtaatcttctttgttcaggcccatttccagcatacgctcgtccagcacgtccagacgctcttcacgctgggagccaccaatgatctcaccgatgcccggagccagaacgtccatagccgcaacggttttaccgtcttcgttaaggcgcatatagaacgctttaatatctttcggatagtttttaaccactaccggtgctttaaagtgttcttccgccagataacgctcatgctcagaagagagatcaacgccccagtaaactgggttttcaaacttcctgccgcagttttcgagaatggtcactgcgtcggtgtaatccacctgcgcaaaatcggcttcaatgaagcgttccagacgtgaaacggcatctttatctacgcgttcagcgaagaatttcatgtcgtctgcgcgttcttcgagaaccgctttgaagacatatttcagcatggcttcagccagacccgcgatatcgttcaggttagcaaacgccacttccggctccagcatccagaactccgccaggtgacggctggtgttggagttttcagcacggaaagtcgggccgaaggtataaattttggataatgcgcaagcgtaggtttcgccgttcaactggccagatacggtcaggaaagactctttaccaaagaagtctttgtcgaaatccactttgccctgatcgttacgcggcagattttccagatccagcgtagaaacgcggaacatttcgccagccccttcggtatcagacgcagtaatcagtggcgttgaaacccagaagaatccctgctcgttaaagaagcgatgcagcgcctgcgccagcgtatggcgaacgcgcgcgacggcaccaatcaggtttgtgcgcggacgcaggtgagcgacttcacgcagatactcaatgctgtggcgttttgccgccatcgggtaagtgtctggatcttcaacccaaccagcaacttcaaccttgctggcctgaatttcaaattgttgcccctggcccggcgacgccacgactttacccgtcacaatgaccgagcaaccggtggtcagacgcaggacgtcttcattgtaattgggcagagaattattgatgacagcctgtacaggatcaaagcaggaaccgtcataaacggcgaggaaggagatgccagcttttgaatctcggcgggtacgtacccatccgcgtacggtgacttcgctgtcaacggctacgcggccctggagtacgtcggctacaggcacaacgctcataatattctctctgttaatagtcggaaaaaataaacacttgtccacccgtaaatggggggatacctatgttacctggcatctgcaatcagacaagcagaattcgcaaatgcagcgaaagatttcggaattaaaggtaaaaaaagggagccgattagctccctgatgatattaactggcttttttaatatgcggaaggtcgaacgctttgcgcagcgcccgaacaaacgctttatcgtggcagatagttttgccagggctgtcagaaagtttcgccaccggtttaccgttacactctaccaacttaatcacaatattcaggggttttacctgggggatatcgcaggtcaggcgagtcccaataccaaaacttaattgcacgcgggaagagaagtggcggtatagctcaaccgctttgcgtaaatccagattgtcagagaaaaccagcgttttactctgtggatcaattcccagcttttcataatgtgcaatggctttttcaccccattcaaccgggtcgccagagtcatgacgcaggccttgataccgactagcgaactcgacaccgaaatcacgcaggaaagcatccatagtgatgcagtcggttaatgcaatgccaagttggtcgggatactcttccagccaggcagcaagtgcagctcgctggctgttggctagatccgggctgatttgctgatgtgcctggaaccattcgtgtgcctgtgttcccatcggcgtgagggaaagccgacgcgccagatcgtagttgctggtgcccacaaaccaggattcctgttgcagacgcttaacgatggtttcttgtacttcgcgagaaaaacggcgacgggtgccaaaatccatcagatggaagcgcgacatatcaagaccggcggttaacgccgagaagtcgactaatttgctttccagcgtgtcgagggcttgcgcaacgtcggcctgcggtgagcgatagcgatgtaccatttcactgataaccgccagcaaaggaacttcccagaggatgacttcacgccacgggccgcttaaacgaatatccagcttgccattatcgttggacacggtgacttgttccgggttaaagcggaactcgcgtaaccagttaagatagtcggccttaaagaaaggcagggcagaaagccactgatattcatcatcctgcaggcgcaggtgctgcatcgcctgaatctgttcacgaatagcatcggcataaatacccagcagatcgtcacctcggcaacgaaactccgccgcgacatgcacatcgtaataatgatgaaacacggcttgctgcatatgcaacttataagcatctgtatccagcaacgagtgcagaacaggagaagcgaattgtgtcataggtgcgcagtagcgtcctcgtacaggagcgtttagtacaataaacatcttcaggaactgctggagtataccttgtttcgcaatttattgaaccccgatcacaccatatgccacctttctggtcgatggcattacgcggtgtatgttataaaaatgtagcaataaaggcgtttgtacctgaaaagatgaagattctgcatagcgcgatttacgcaacaggaatagactgaacaccagactctataaaagatgctaaaggttatttatgactcaacagccacaagccaaataccgtcacgattatcgtgcgccggattaccagattactgatattgacttgacctttgacctcgacgcgcaaaagacggtcgttaccgcggtcagccaggctgtccgtcatggtgcatcagatgctccccttcgtctcaacggcgaagacctcaaactggtttctgttcatattaatgatgagccgtggaccgcctggaaagaagaagagggcgcactggtcatcagtaatttgccggagcgttttacgcttaagatcattaatgaaataagcccggcggcgaatacggcgctggaagggctttatcagtcaggcgatgcgctttgcacccagtgtgaagccgaaggtttccgccatattacgtattatctcgaccgcccggacgtgctggcgcgttttaccaccaaaattattgccgataaaattaaatatcccttcctgctttccaacggtaaccgcgttgcgcaaggcgaactggaaaacggacgccattgggtacagtggcaggacccgttcccgaaaccgtgctacctgtttgcgctggtggcaggcgactttgatgtactgcgcgatacctttaccacgcgttctggtcgcgaagtagcactggagctgtacgtcgatcgcggcaaccttgatcgcgcgccgtgggcgatgacctcgctgaaaaactccatgaaatgggatgaagaacgctttggcctggagtatgacctcgacatctatatgatcgtcgcggtggatttcttcaatatgggcgcaatggagaataagggtctgaatatctttaactccaaatatgtgctggcccgcaccgacaccgccaccgacaaagattacctcgatattgaacgcgttatcggccatgaatatttccataactggaccggtaaccgagtgacctgccgcgactggttccagctcagcctgaaagaaggtttaaccgtcttccgcgatcaggagttcagctctgaccttggttcccgcgcagttaaccgcatcaataatgtacgcaccatgcgcggattgcagtttgcagaagacgccagcccgatggcgcacccgatccgcccggatatggtcattgagatgaacaacttctacaccctgaccgtttacgagaagggcgcggaagtgattcgcatgatccacaccctgcttggcgaagaaaacttccagaaagggatgcagctttatttcgagcgtcatgatggtagtgcagcgacctgtgacgactttgtgcaggcgatggaagatgcgtcgaatgtcgatctctcccatttccgccgttggtacagccagtccggtacaccgattgtgaccgtcaaagacgactacaatccagaaactgagcagtacaccctgaccatcagccagcgcacgccagctacgccggatcaggcagaaaaacagccgctgcatattccgtttgccatcgaactgtatgataacgaaggcaaagtgatcccgttgcagaaaggcggtcatccggtgaattccgtgctgaacgtcactcaggcggaacagacctttgtttttgataatgtctacttccagccggtgcctgcgctgctgtgcgaattctctgcgccagtgaaactggaatataagtggagcgatcagcaactgaccttcctgatgcgtcatgcgcgtaatgatttctcccgctgggatgcggcgcaaagtttgctggcaacctacatcaagctgaacgtcgcgcgtcatcagcaaggtcagccgctgtctctgccggtgcatgtggctgatgctttccgcgcggtactgcttgatgagaagattgatccagcgctggcggcagaaatcctgacgctgccttctgtcaatgaaatggctgaattgttcgatatcatcgacccgattgctattgccgaagtacgcgaagcactcactcgtactctggcgactgaactggcggatgagctactggctatttacaacgcgaattaccagagcgagtaccgtgttgagcatgaagatattgcaaaacgcactctgcgtaatgcctgcctgcgtttcctcgcttttggtgaaacgcatctggctgatgtgctggtgagcaagcagttccacgaagcaaacaatatgactgatgcgctggcggcgctttctgcggcggttgccgcacagctgccttgccgtgacgcgctgatgcaggagtacgacgacaagtggcatcagaacggtctggtgatggataaatggtttatcctgcaagccaccagcccggcggcgaatgtgctggagacggtgcgcggcctgttgcagcatcgctcatttaccatgagcaacccgaaccgtattcgttcgttgattggcgcgtttgcgggcagcaatccggcagcgttccatgccgaagatggcagcggttacctgttcctggtggaaatgcttaccgacctcaacagccgtaacccgcaggtggcttcacgtctgattgaaccgctgattcgcctgaaacgttacgatgccaaacgtcaggagaaaatgcgcgcggcgctggaacagttgaaagggctggaaaatctctctggcgatctgtacgagaagataactaaagcactggcttgataaataaccgaatggcggcaatagcgccgccattcggggaatttacccctgttttctcaggcgagtttcagattcaccacgttgcatcacccgttgcaacacctccgcttccagctccgctaatcgcaccgaccctaatcgacgcggacgggggatatccactgtcaaatccagaccaatttttccctcttcaattaacagcacccggtcagccatcgctaccgcttcgctcacatcatgcgtcaccaacagtacggtaaagccgtgctcctgccaaagtgacacaatcaaatcctgcatctcgagtcgcgttaaggcgtccagcgccccgagcggttcatcaagcaacaataatcccggtcgatgaatcaacgctcttgccagcgccactcgctgtttctgcccgccagaaagtgcggcaggccattcccctgcgcgattctccagtcctaccgcagccaacgctcgacgtgcggcatcgcgccactggcctttaaggcctaacccaacgttatcaatcaccgatttccacggtagcagacgcgcatcctgaaacatcattcgcgtgtcttcctgaatttcagccagcggtgtggtgcccgctaacacatcgcctgcggttggcgtttccagacctgccagcaggcgcagcagggtacttttgccaccaccgctgcggcccaccaccgccacaaactgacctgccggaatatgtaaatccagttggttcaggacgatattttccgcgtaatgtttgcttactgcattgagcaacaatggcgtgccctggttcagacgagcagtattcataccgtggcctccttcaaatgataagccgggttccagcgcaaccagaggcgctctaacagctgcgcgctgacgtcagccagtttgccgagcagggcgtaaagaataatagcgactaccaccacgtccgtttgcaaaaactcccgcgcattcatcgccagataaccaatgcctgaattggcagaaatggtttcggcaacaatcagcgtcagccacatcaggcccaacgcaaaacgcacgccgaccataattgagggcagggcaccaggcaggatcacatggataaacagcggtatgccggataatccatagctacgcgccatctccaccaacccgcgatcgatattacggatgccatgccaggtgttgatataaatggggaatagcgtaccgagcgccaccagaaagatttttgcggattcatcaatgccaaaccacaaaatcaccagcgggatcagcgccagatgcggcacgttgcgcaacatctgaattgaggtatccagcagccgttctccccagcgagatagcccgctaatcagtcccaaaatcaaccccagcgatccgccaattgaaaagccaatcagcgcccgccaggagctgatcgccagatgctgccacagttcgccgctggcggagagcgtccagaacgccgtcaccactccttccggtgaaggcaaaatacgcgtcgacagccagccaaccgaggaggccagttgccacaccgccacgatgcccaccggtaaaaaccagggggcaacgcgcaataaccacttcttcactggcgttgccattatttcttccttagctttgcgcgactttacgggggataaaatcattcgccaccgcttcgccttgcggattcagcggctgcggctggggaatttccgggatggcgacatccagaagcgggaacagcaactcgccaacccgatacgcttcttccagatgcggatagcccgaaagcacaaaactgtcgatgccaagcgcggcatattcgttgattcgcgcagcgaccgtaggaccatcgcccaccagcgccgtcccggcaccgccgcgcactaagccaacgcccgcccataaattggggctgatctccagattgtcgcgcttgccgttatgtaacgccgccattcgctgttgccctacggaatccgtccgggcgaatgcggcctgtgctttggcgatagtttcatcatcaagatgcgagattaaccgctcggcggcctgccacgcttcgtcgttagtttcacgaacaatcacatgcagacgaataccgaaacgaattttgcgtccatgcgcggcagctttcgcccgcacttgttcgattttctctttaaccagttccggcggttcgccccaggtgaggtagagatcaacctgttctgccgccagctcctgggcgacatctgacgatccgccaaagtaaagtggcggatacggctgttgaatcgccgggaagagcagttttgctccgcgcacatgaatatgtttaccgttgaaatcgacggtttctctctgcaataaacgccgccagacctgggtaaattccgccgaggcttcgtagcgctcgctatgatcaaggaacactccgtcgcctgccagctcttgtggatcgctgcctgtgaccaggttaaacaacgcacgtccatttgagagacggtcaagcgtggcggcctggcgggcggcaacggtaggtgaggttacgctgggacgcagggcgacaagaaacttcagccgctgcgtcaccgggatcatcgatgcggcaaccagccacgcatcttcgcaggagcgccccgttggaattagcacaccggtatagccaagacgatccgccgcttgcgcaatttgttgcagataaccgtgatcaaccgggcgtgaaccttcttccgttcccagataatgcccgtcaccgtgggtcggtaaaaaccagaacatattcagactcataattgttttccttccagttgagtgggctgccagatgcgctggcgaatatcgacttttttcggcaccagacgattttcataaaacagatctgccgtttgctgctgtaaggcggcaacctcggcgttaaccggtttgatggtggtaggagggcgatgatctaagtaagaggcaatcaccggtgccggtaagcccatcgtttttgccagtaaagcgatgctttgctcgcgctggctgcgggttaacgcatcggcctcactaaaggttgccagtacgccctgaataaaagcgccgtttttttctgcatagggacgagctgccagataaaacgatccagtttgattgagatcggtgccgtctttcagcacccgcacgccgccctgtaataatgcagcagagtagtagggatcccagatagcccaggcgtcaacgttaccttgctggaacgcggcgcgggcatcagcgggcgtcaggtaagtgggttggatatcggtaaacttaagtccggcctgacgcagtgcacgcagtaaaaggttgtgtgaactggaacctttctgaaaggcaactttgtgacctttaagatcggctacggttttgatcgggctgttttctgccaccagaatcacttcggctttgggcttcggtggctcgacgcccacatataccaaatcagccccggcagcctgggcaaagattggcggaatatccccggtactgccgagatcaatactgccaacgtttaacgcttccaacatttgcggacccgcggggaactccacccaggagatttttgattgcggatagcgtttttccagtaactggtggctttttgccagtaccataccaatactgcctttctgatagcctatacgtaacgcttcaggcgaggattctgcagcaaccgcaatcgtagagacgctaagcaatcccaccagcgccagtttaatgatgttacgcatgggcattacctcgcagagacagaaggtcaggaacctgaacatcgcggcggtgcaatgcctgccagaaagtttctagcgcggtatcaagacgggtttgcagatttggcgtgaactggggtctgtgatggtaatcaattacttgtgagtcatcggcaaacacgccgtgcaggatctcctgagctttcagtgcgcttaaaactggtttaagggcataatcgaccgccagcagatgggccacggtaccgcccgtcgccagcggtagcaccactttgccttgcaaagcgcgctctggcagcaggtcgagcagggttttcagcgcgccggaataggcggctttatacacaggtgtagcgactatcagtccatcagcctgttgcagctgttcggtgaaggtcttgagtgccggactatcgaaacgagcataaagcagatcttccggggcgaagttttgcagattccagtgataaacctctacatccaggccatttagtttttcccgcgcatattccagcaaggagctggagcgagaaggaaagcgaggactacccgccagggtgatgacacgcatactctctccttataaccaattgttctttttttgttaacattgataacaattcggtcagtctgtcggagagacaagaaaatgccaaatataaattttgtgtatctttttctgaaaataaactaaagaaagggctttatatatcacgcatatttatttgttggatagtcattagatgttgaatcaatgaattactcgttcagttaatatttaaatattcatgaaatctataaattaaagatttgtcacttattggatttagtatgcttgatttaaatggcggacaattattgttattattaagtctaatgtcatttaaaggcattatcatatttacgaagagatcaggatgataacgatgaaaaaaagtgtattgacggcgtttataactgtggtatgtgtaacgtccagcgttatggctgctgatgataatgctatcacggatggctcagtaacatttaatggtaaagttattgctccagcttgtaccctggtagctgcgacgaaagattccgtggtgactttgccagatgttagtgccacgaagttgcaaaccaatggtcaggtttctggcgtgcaacctgatgtgccaattgaattaaaagattgtgatactaccgtaacaaaaaatgcaacgttcacctttaatggcactgcggatactactcagattacagcgtttgctaaccaggcctcatctgatgctgctacaaacgtggccctgcaaatgtatatgaatgatggtacaacggccatcacgccagacacagaaaccgggaacattttgttgcaggatggagatcagacgttgacttttaaagttgattatatcgctacggggaaagcgactcaggtaatgtgaatgcggtaacaaatttccatattaactattattaatagaactcattaattgttttattaattagtacccctccagtgttctggaggggatattcatattttttaagagtgactatttatgaaaacttgcataacaaagggaattgtgaccgtaagtttaacggcaatattactcagctgctcatccgcatgggcggcaggtaaaggcgggattggacttgcagcaacacgtcttgtttattcagaaggtgaagagcaaatttcactgggtgtacgtaacaccagtccggatgtttcttatcttattcagtcatgggtgatgaccccagataataaaaaatcagcagactttattattacaccaccgctatttgtgctgaatccggcaaatgagaatctgttacgcattatgtacattggagcgccgttggcgaaagacagagaaacccttttcttcactagcgtacgggcagtcccttcaacaacgaagcgggaagagggaaataccctgaagattgccacacaaagcgtcatcaaacttttctggcgaccaaaaggtttagcgtatcccttagccgaggctccggcgaaactgcgttgcacttcgtcagctgacatggttacggtcagtaacccaacaccttatttcattaccctgacagacctgaaaataggtggaaaggtagttaaaaatcaaatgatttccccctttgataaataccaattctctctgccaaagggtgccaaaaatagcagcgtaacgtatcgaaccatcaatgactacggggcggaaacgccgcaactcaactgtaaatcgtaattcgtcttcagttaagagagcgagatgtatagaactcaccgacaacacagcctgttaagctctggtggagtgccatcgtttattggtgggctggtggtgtttgtgtcggcagcgttcaatgcacaagctgaaacctggttcgaacctgcctttttcaaagatgatccctcaatggtggccgatttgtctcgtttcgaaaaaggacaaaaaataacgccaggggtttatcgtgtcgatattgttctgaatcagacaattgtagatacgcgcaacgtcaattttgttgagttaacgccagagaaggggattgccgcctgtttgacgactgaaagcctggatgcaatgggtgtgaatactgatgcgtttccggcttttaaacaactggacaaacaagcgtgtgcgctattggcggagattattccggatgccagcgtaacttttaatgtgaataaactccgtctggaaatttcagtaccgcaaattgctataaaaagtaacgctcgtggttatgtcccccctgaacgttgggatgaagggatcaacgcgctattactgggatattcatttagcggggctaacagtattcatagcagcgcagacagtgattctggcgacagttattttctgaatttaaacagtggcgttaatttaggcccatggagattgcgcaacaattcaacatggagtcgcagtagtggccaaaccgcagaatggaagaatctcatcagctatttgcagcgggcggttattccactaaaaggcgaactgaccgtaggtgatgattatactgcaggcgattttttcgatagtgtcagctttcgtggtgtgcagctggcgtcagatgacaacatgctgccagacagcctgaaagggtttgcgcctgtggtgcgtggtatcgccaaaagcaatgcccagataacgattaagcaaaatggttacaccatttaccaaacttatgtatcgcctggtgcttttgaaattagtgatctctattccacgtcgtcgagcggtgatttgttagttgaaatcaaagaagcggacggcagcgtcaatagctacagcgtaccgttttccagcgtgccattactccagcgtcaggggcgaatcaaatacgcggtgacactggcgaaatacagaaccaatagtaatgaacagcaggagagcaaatttgcccaggccacgttgcagtggggcggaccgtggggaacgacatggtatggtggtggacaatatgctgaatattaccgtgccgccatgtttggtctgggatttaaccttggcgatttcggagcaatttcgttcgatgcgacccaggcgaagagtacgctggcagaccaaagcgaacataaaggtcagtcatatcgttttctgtatgccaaaacgctcaaccaattgggcactaattttcaattgatgggctatcgctattcgacgtcgggtttctacaccctttccgacaccatgtataaacatatggatggctacgaatttaatgacggtgatgatgaagatacgccgatgtggtcgcgttattacaatttgttttacaccaaacgtggcaaactgcaggtcaatatctcccagcaattaggcgagtacggttcgttttatttaagtggtagccagcaaacttactggcataccgatcaacaggatcggctattacagtttggctacaacacgcaaattaaagatctctcgctggggggttcctggaactacagtaagtcccgtggtcaacctgatgctgatcaggtgtttgcactaaatttttccctgccgctcaatctgttgctccccagaagtaatgatagctataccaggaaaaaaaattacgcctggatgacctctaacaccagtatcgataacgaagggcacattacacaaaacctgggtttaacggagacactactcgatgacggtaacctgagctacagcgtgcaacagggatataacagcgaggggaaaacggctaatggtagcgccagcatggactacaaaggggcgtttgcagatgcccgagtgggctacaactacagcgataacggcagtcaacaacaactgaactacgctctttcaggcagtttagttgcccattcacagggcattaccctggggcaatcgctgggggaaactaacgttctgattgcagcaccaggcgcagagaatactcgtgtggcgaacagcaccgggctgaaaactgactggcgcggatataccgttgttccttatgccacttcttatcgggaaaatcgaatcgcacttgatgcggcgtcgttaaaacgtaacgtggatcttgaaaatgcagtagtcaacgtggttcccaccaaaggggcgttggttctggcggagttcaatgcccatgcgggtgcaagggtattaatgaaaacatcaaagcagggtataccgctgcgttttggcgcgatagcgacgctggacggcgtacaggctaatagcggcataattgatgatgatggctcgctctatatggcgggtttaccggcgaagggaacaataagcgtgcgctggggcgaagctcccgatcaaatttgtcatatcaattacgagcttaccgaacaacaaattaactctgcgattacgcgaatggatgccatatgcagataatctttggagaaaaatgcgtgtcattactacgactattttttgccgccgtcttaatgctatggtgcgctcaaaccgctgcttatagcgggcagtgtcatactactcaggggaatccgtatattggcgtcaattttggcgttaaaaccctggaggaagaagcaaatacggcaggggtagttaaagacaaattttatcagtggaacgaatcgaatgattattatgtttcctgtgattgcgataaagacaatgtcagaagtggccgatgggcattcgccgcggattcaccgttagtctatttaggcgacaactggtacaaaattaatgactatcttgccgccaaagttttattgcaggttaaaggcagttctcctactgcggttcctttcgaaaacgtgggcacagggggggatacccgatggcatatttgcgaccctggcggtcaacgtttaggtgggcagggggcaagcggtaatagcggtagcttttccctgaaaatattgcagccgttcgttggctcggtcgtcattcctcctatggcgctggcgcgattatatgaatgctacaacatacccgcaggtgattcctgcacgactacaggtacaccggttttagtgtattacctgtctggtacgatcaattcacttggctcatgttccgtcaatgccggagagacaattgaagttgatttaggtgatgtcttcgctgccaatttccgtgttgtagggcataaacctcttggggccagaacagcagaacttgcaattccagtcaggtgtaacacgggaaacgcgggattagttaatgtcaacctgagtctgacggcaaccacagaccccagctatccccaggcgattaagacgtcacgtcctggcgtgggcgtggtggtgaccgatagccagaacaacattatttcccctgctggtggaacattaccgctctctattcctgatgatgcagacagtatcgcgcgaatgaatgtctatccagtcagcacgacaggtgtaccaccagaaaccgggcgatttgaagccacggcaacggtgagaataaattttgattaacgcgtgaacgtatgaagaaaaaaacgatatttcagtgcgttatcttgttctttagcattcttaacatccatgtcgggatggctgggcctgaacaagttagtatgcatatttatgggaatgtggtcgatcagggctgtgatgtcgccaccaaaagtgcattacaaaatattcatattggtgattttaatatcagtgattttcaggccgcgaataccgtaagcactgctgctgatttgaatatcgatatcaccggttgtgccgctggtattactggcgcggacgtcctttttagcggcgaggctgacacccttgcgccgacactgctcaaactaactgacacaggcggaagcggtggtatggcaacggggattgccgtgcaaattcttgatgcgcaaagtcagcaagaaatcccgctcaatcaggtccagcctcttacgcccttaaaagccggggataacacactcaaatatcaacttcgttataagtccacaaaggcgggagcaacgggcggtaatgcgacggcggttctctattttgatctggtttaccagtgaaggagtgatgttgaaacggataatctggattctgttcttattgggattaacgtggggctgtgagctatttgcccatgatggcacggtcaacattagcggatcgtttcgccgtaatacatgcgtgctggcacaggatagcaagcaaatcaatgtgcagttaggcgatgtctcgctgacacgtttttctcatgggaattatggcccggagaaatctttcatcattaatttgcaggattgcggaacagatgtcagcacggttgacgtcaccttttcaggaacccccgacggagtgcagagcgaaatgttgtccattgaaagtggtacggatgcagccagcgggctggcaattgcgattctggatgatgcgaagatattgattccgcttaaccaggcgagtaaagactacagcctacatagcggtaaggtgccattaactttttatgcgcaattgcgacctgtcaatagcgatgtgcagtcgggtaaagtgaatgccagcgcgacatttgtacttcattatgactaatacgtggaacagattggcgctcttgattttcgccgttttatcgctgctggtggcgggtgaattgcaggcaggagtggtggtcggcggaacgcgatttatctttccggcagacagagaatcgatatctattttactgactaataccagtcaggaatcctggcttattaacagtaaaatcaaccgcccaacgcgttgggccgggggggaagcgtcgacagtgccagcaccattactggccgctccgccacttattctcctgaagcccggtacgacaggcacgttgcgcttgctgagaacggaaagcgacatcttgcctgtggatcgcgaaacgctatttgagttaagcattgccagcgtgccatccggcaaagttgaaaatcagagcgtaaaagtggcgatgcgctcggtatttaaactgttctggcgacccgaaggtttgccgggcgacccgctggaagcttatcaacaattacgctggacacggaattcgcagggtgtacaactcactaacccaacgccttattacattaacctgattcaggtgagtgtaaatggtaaagcgttaagtaatgtgggagttgtgccgcctaaaagccagcgtcagacaagctggtgtcaggcaatcgcaccgtgtcatgtcgcctggcgggcgataaatgattacggcgggttgagtgcaaagaaggagcaaaatctgccctgaaacaggttcggaaaacgtttgcgtttttttgccgcaggtcaattcccttttggtccgaactcgcacataatacgcccccggtttgcacaccgggaatccaggagagttcatgtactaccccttcgttcgtaaagcccttttccagctcgatccagagcgcgctcatgagtttacttttcagcaattacgccgtattacaggaacgccgtttgaagcactggtgcggcagaaagtgcctgcgaaacctgttaactgcatgggcctgacgtttaaaaatccgcttggtctggcagccggtcttgataaagacggggagtgcattgacgcgttaggcgcgatgggatttggatcgatcgagatcggtaccgtcacgccacgtccacagccaggtaatgacaagccgcgtctctttcgtctggtagatgccgaaggtttgatcaaccgtatgggctttaataatcttggcgttgataacctcgtagagaacgtaaaaaaggcccattatgacggcgtcctgggtattaacatcggcaaaaataaagatacgccagtggagcagggcaaagatgactatctgatttgtatggaaaaaatctatgcctatgcgggatatatcgccatcaatatttcatcgccgaataccccaggattacgcacgctgcaatatggtgaagcgctggatgatctcttaaccgcgattaaaaataagcaaaatgatttgcaagcgatgcaccataaatatgtgccgatcgcagtgaagatcgcgccggatctttctgaagaagaattgatccaggttgccgatagtttagttcgccataatattgatggcgttattgcaaccaataccacactcgatcgttctcttgttcagggaatgaaaaattgcgatcaaaccggtggcttaagtggtcgtccgcttcagttaaaaagcaccgaaattattcgccgcttgtcactggaattaaacggtcgcttaccgatcatcggtgttggcggcatcgactcggttatcgctgcgcgtgaaaagattgctgcgggtgcctcactggtgcaaatttattctggttttatttttaaaggtccgccgctgattaaagaaatcgttacccatatctaattatttcttcgaattcctctttataagataatcagggctttattttcagccctggttgttttatattcatctctgttgcttatttagacattttgtacttttattgttgaggttattaagcgaagcgacaatggattgtgttgctgcggttttatagggtaggggagaggcagatgcgaattaaaccagacgataactggcgttggtattacgatgaagagcacgatcgaatgatgctcgatttagccaatggtatgctatttcgctcacgttttgcgcgcaagatgttgactccagatgccttttctcccgcaggcttttgcgttgacgacgccgcgctctatttctcttttgaagaaaagtgccgcgattttaatttatctaaagaacaaaaagccgaactggtgctgaatgcactggtagcaattcgctatctcaaaccgcaaatgccgaaaagctggcattttgtttcccatggtgaaatgtgggtgcccatgccgggcgatgcggcctgcgtttggttgagcgatactcacgagcaggtcaatttgctggtcgttgaatctggcgaaaatgccgcactatgcctgctggcacaaccctgcgttgttattgcgggtcgcgcgatgcagttgggcgacgccattaaaatcatgaacgacaggctgaaaccgcaggttaatgttgacagcttcagcttcgaacaggcagtctaacgcgccaacttaagtgcagtcttcggtacacagctacagcaaagaatggtgccatcatcgcccattgctgattttttcagcggcgtgacttcgccttctaaaagctgaacacggcaacttccacaaatgcccgcgcggcaagaataagggatacgaattccctgattttctaattgctccagcaacacctgttggttatttccacgaaatgcctgtccctgccagtcaatatctacatttgcgtccggttgttgcgtgatgttggcggtatcatcagcggcagctgcgccgtaaatttttgccggagccgttgccagaatttccacctcatcgccaacgcgaatcacgccgctattacgggcaattaaattctgaccaaaatcgacatcgccgttatcctgggcagtgcggaaagattgcaatgtttttaatggttcgcctgccggatgtttttgccctttttctgggctgacggtggtgaaaatacagcggctacaaggtttaaccacatcaaacaccacatcaccaatgcgaatcactttccagcgatcttcttcccaggctgacgcgccggaaaccaccagattggggcggaattgctccatttttacactggccggacaacgttgttggagatcacgtaacgaggcttcgttagcaagaaggtaaggatagccatcagcaaatgacagaggtacagtgttgtggcgtttcacgcgccgggtcatttgtggccccacccagcgtaattgcacttcgcgggagaaaaatccacttagccatttgttgatcgcgtctggcgcaattcgcgcggtaaaatgtgtgccccaaacttcggttggtgcgtcttgtgtggcgaaatcagcaaaacgaacatatgcgctactgccatctggtgcggtgagatgcaagccatcatgcacaggtgaaggagtaaaccgtaccatctggggaaactggcgagcggtaataaacgtaccgtcaggttccgtgatcataaagatgcgatcgaaggccagaccactgacatctgccagagcatgtgtaagaccaatgccgcgcatcgatttaacaggatgaataaaaagccggattaatgtcgccacggtgcggtcctcaaatgaaaataagccctcaactttatgacatgacgcgcttattagctataatgcgcaacaattttcttagcgcctgtcccattaggctattttatttgtcagtttggccctgggttatgctcgaaatcctcacgtacttgtgtacgctccggtttctccgcgctgtccatgtccagactgactgcaacaattacgcctactgcggtaggctcttagagtaaaagtgacgatatgaattctctgtttgccagtacggcccgtgggctggaagagctgttaaaaactgaactggaaaacctgggggccgttgaatgccaggtggttcagggtggggtccatttcaagggcgacacacggcttgtttaccagagcctgatgtggagccgcctggcctcgcgtattatgttgccgctgggcgagtgtaaggtttacagcgatttagacctctatctcggtgttcaggcgatcaactggacagagatgtttaatcctggcgcgaccttcgctgtccacttcagtggtttgaatgacaccatccgcaacagtcagtacggcgcgatgaaagtgaaagacgcgatcgtcgatgctttcacgcggaaaaatctgccgcgtccaaatgttgatcgcgatgcgccggatatccgcgttaacgtctggctgcataaagaaaccgccagtatcgctcttgatctgagtggtgatggtttacatctgcgtggctatcgcgatcgtgctggtattgcgccgatcaaagaaaccctggcagccgctattgtgatgcgatccggctggcagccaggaacaccgctgctcgatccgatgtgtggttccggtacgttgctgattgaagcagcgatgctggcgaccgatcgcgcaccaggcttgcaccgtgggcgttggggctttagcggctgggcgcagcatgatgaagctatctggcaggaagtgaaagcggaagcgcaaactcgcgcccgtaaaggcctggctgagtatagctctcatttttacggttcggacagcgacgcacgggtgattcaacgtgcacgcactaacgcccgtcttgcggggattggtgaactgatcacctttgaggtgaaagatgtcgcgcaactgaccaatccgctgccgaaagggccgtacggcacagtgttgagcaacccgccatacggggaacgtctggacagcgaaccggcgctgattgcgctgcatagcctgctgggtcggatcatgaaaaaccagtttggtggctggaatctctctttgtttagtgcctcgccggatctgctaagctgcttgcagctgcgtgcagacaaacagtacaaggcgaaaaacggcccgctggactgcgtacagaaaaattaccacgttgccgaaagcactccagacagcaaaccggcgatggtagcggaagactacaccaaccgcctgcgtaagaacctcaaaaaattcgagaagtgggctcgccaggaagggattgaatgttaccgcctgtatgacgccgatctgccagaatataacgttgccgttgaccgttatgccgactgggtggtggtgcaggagtatgcgccgccaaaaactattgatgctcacaaagcgcgtcagcgtctgttcgatattatcgctgcaaccatttcggtactggggattgcgccaaacaaactggtgctgaaaacccgtgaacgccagaagggcaaaaaccaataccagaaactgggcgagaagggcgagtttcttgaagttaccgaatataacgctcacttgtgggtgaacctgacggattatctcgatactggtctgttcctcgatcaccgcatcgcccgtcgtatgctcggtcagatgagcaaaggcaaagatttcctcaacctgttctcttataccggcagcgccaccgtgcatgcgggattaggcggtgcacgcagcaccaccaccgtggatatgtcgcgtacttatctggaatgggcagaacgcaacctgcgtctgaatggcctgaccgggcgtgcgcatcgcctgattcaggccgattgcctggcgtggctgcgtgaggcaaatgaacagttcgatctgatctttatcgatccgccaaccttctctaactcaaaacgaatggaagatgcgtttgatgttcagcgcgatcatctggcgctgatgaaagatttgaaacgtctgctgcgtgcaggtgggacgatcatgttctcgaacaacaaacgtggcttccgtatggatctcgacggcctggcaaaactgggactgaaagcacaagaaattacgcaaaaaacgctctcccaggatttcgcccgtaaccgccagatccacaactgctggctgattaccgcagcctgaaaggaatagtaatgtcattaatcagtatgcatggcgcatggctgtcgttcagcgacgcgccgcttctcgataacgcagaactgcatatcgaagataacgaacgtgtttgtctggtgggccgcaacggcgcaggcaaatcgacgttaatgaaaatcctcaaccgtgaacaagggctggatgacggtcgcattatttacgagcaagatttgattgtagcgcgtctgcaacaggatccgccgcgtaacgttgagggtagcgtttatgatttcgttgccgaaggcattgaagaacaagcggaatatctgaaacgctatcacgatatttcgcgcctggtgatgaacgacccgagcgagaaaaatctcaacgaactggcgaaggttcaggaacagctggatcaccacaacctgtggcagctggaaaaccgcatcaacgaagtgctggcgcaactggggttagatcctaacgttgcgctgtcgtcgctttccggcggctggttgcgtaaagcggcattaggacgcgcgctggtgagtaatccgcgcgtgctgttgcttgatgaaccgacaaaccacctggatattgaaaccatcgactggctggaagggtttttgaaaactttcaacgggacgattattttcatctcccacgaccgttcgtttatccgcaatatggcgacgcgcattgttgatctcgatcgcggcaagctggtgacctatccagggaattacgaccagtacctgctggaaaaagaagaagccctgcgcgtggaagaattacaaaatgccgagttcgatcgcaaactggcgcaggaagaggtgtggatccgccaggggatcaaagcacgccgtacccgtaatgaaggccgcgtacgcgccctgaaagcgatgcgtcgcgaacgtggtgaacgtcgcgaagtgatgggtaccgcaaagatgcaggtggaagaggccagccgctccggtaaaatcgttttcgaaatggaagacgtttgctaccaggttaacggtaagcaactggtgaaagatttttctgcccaggttctacgtggcgacaaaattgccctgattggtccgaatgggtgcggcaaaaccacgctgctaaaactgatgctcggtcagcttcaagcggacagcgggcgtattcacgttggcaccaaactggaagtggcttatttcgatcagcaccgcgcggaactggatcccgataaaacggtgatggataaccttgccgaaggtaagcaagaggtgatggttaacggcaagccacgccacgtattgggctatttgcaggactttctgttccatccgaaacgggcgatgacgccggtacgtgcgctttctggcggtgagcggaaccgcttgctgctggcgcgtttgttcctcaaaccaagcaacttattgattcttgacgaaccgaccaacgatcttgatgtcgaaacgctggaactgctggaagaactgatcgacagctatcagggcacggtattgctggttagccacgatcgtcagtttgtcgataacaccgttacagaatgttggatcttcgaaggcggcggtaaaattggtcgttatgtcggcggttatcatgatgcccgtggtcagcaagagcagtatgtggcgctcaaacagcctgcggtgaaaaaaaccgaagaagccgccgcggcaaaagcagaaactgtaaaacgcagcagtagcaaactaagctataaattgcagcgcgaactggagcagctaccgcaattgctcgaagatctggaggcgaagctggaagccctacagacgcaagtggcggatgcttccttcttcagtcagccgcatgagcagacgcaaaaagtgcttgctgatatggctgctgcagagcaggagctggagcaagcctttgaacgctgggagtatcttgaagcgttaaaaaatggtggctgatcgcaaaatagtcgatttaaacagagacagctgacaacggtaaaattgcctgatgaactgggtttatcaggcatgaaaaccaacactttgttagtcatctgtaaaatagcgcatcattaaggagtaccaatgtgcgaacatcatcatgccgcgaagcacatcctgtgctcgcagtgtgacatgctggtggcgttaccgcgccttgagcatggtcagaaagcggcatgtccccggtgtggcacaacgttaaccgtggcgtgggatgcccctcggcagcgtcccaccgcctatgcgttggctgcactgttcatgctgttgctgtccaacttgtttccttttgtgaatatgaacgttgcaggagttaccagtgaaattacattactggaaattcccggcgtgcttttttctgaggactacgccagcctcggcacctttttcctgttgtttgtgcaactggttcccgcgttttgtctgataaccattctgttactggtgaatcgcgcggaattaccggtccgtttaaaagagcaactggcacgggtgctttttcaactcaaaacctggggaatggcggagattttcctcgctggtgtgctggtcagtttcgttaaactgatggcttacggcagcattggggtaggcagcagctttctcccctggtgtttattttgtgtcctgcaactgcgcgcttttcagtgcgttgatcgtcgctggttatgggacgacatcgccccgatgccagaactgcgccagccgctaaaaccaggcgtcacggggatacgtcaggggctgcgttcgtgctcctgttgtacggcaatccttcctgctgatgaacccgtgtgcccgcgttgtagtaccaaagggtacgttcggcgtagaaacagcctgcagtggacactcgcgctgcttgtaacgtccatcatgctgtatcttccggctaatattttgcccatcatggtgacggatttattaggctcgaagatgccgtcgacgattctcgctggggtcattctgttatggagcgaaggctcttatcccgtcgctgcggtgatctttctggccagtattatggtgccaacgttaaagatgatcgccatcgcgtggctgtgttgggatgccaaagggcatggcaagcgcgacagtgaaagaatgcatttgatttatgaagttgttgagtttgtaggccgctggtcgatgattgacgttttcgttatcgcggtgctctcggcgctggtgcgtatgggaggtttaatgagtatttatccggcaatgggtgcattaatgtttgctttagtcgtcataatgacaatgttttctgctatgacgtttgacccgcgtttgtcgtgggatcgtcaacctgaatcagagcatgaggagtcctgacagtatggaatctaataatggggaagccaaaatccagaaagtgaagaactggtctcccgtgtggatatttcctatcgtcacggcgctcattggggcctgggttcttttttatcattacagccatcagggaccggaagtgaccctgatcaccgcgaatgcggaaggaattgaaggtggcaaaaccaccattaaaagccgtagcgttgacgtcggcgtggttgaaagcgccacactggctgatgatttgacgcacgttgaaatcaaagcgcggctgaattccggtatggaaaaattgctgcataaagacaccgtcttttgggtggtgaaaccgcagattggtcgcgaagggattagcggcctgggaacgctgctgtctggagtttatatcgaactgcagccaggcgcgaaaggcagcaaaatggataaatacgatttgctggactcgccaccgttggccccgcctgatgcgaaaggtatccgtgtgattctcgatagcaaaaaagccgggcagctctcgccaggagatccggtgctgttccgtggctatcgggtaggttcggttgaaaccagcaccttcgatacacaaaaacgcaatatcagctatcaactgttcatcaatgcaccttatgaccgactggtgaccaacaatgttcgcttctggaaagatagtggcattgcggttgatctgacgtcagcagggatgcgtgtggagatgggctcattgacaacgctgctgagtggcggtgtcagctttgatgtgccggaaggtctggatttagggcagccagtggcaccgaaaacagctttcgttttgtatgatgatcagaagagcattcaggattcgttgtacaccgatcacattgattatctgatgttctttaaagattcggtacgcggtctgcaaccgggagctccggtagagttccggggtattcgcctgggtaccgtaagcaaagtgccattctttgcgccgaatatgcgtcagacatttaacgatgattaccgtattccggtactgattcgtatcgagccagagcggctgaaaatgcagcttggcgaaaatgcggatgttgttgagcaccttggcgaattgttgaaacgtggtttacgcggatcgctgaaaaccggaaacctggtcactggtgcactgtatgttgatctcgatttctatccaaatacgcctgcaataaccggtattcgtgaatttaatggttatcagattatcccgaccgttagcggcggcctggcgcaaatccagcaacgactgatggaagcgttggataagatcaacaaactgccattgaatccgatgattgaacaggcaaccagtacgctttctgaaagtcagcgcacaatgaaaaacctgcaaacgacgctggatagcatgaacaagatcctcgctagccagtcgatgcagcagttgccgacggatatgcagtcaacgttgcgtgaattgaatcgcagcatgcagggcttccagcctggctccgcagcctacaacaagatggtggcggatatgcagcgccttgatcaggtgttgcgagaactgcaaccggtgctgaaaacgctcaatgagaagagtaacgcgctggtatttgaagcgaaggacaaaaaagatccagagccgaagagggcgaaacaatgaaaaagtggctagtgacgattgcagcactgtggctggccggatgcagctccggcgaaattaataaaaactattaccagttacctgtggtgcagagcggtacacaaagtaccgccagccagggcaatcgtctgttatgggtagagcaggtcactgttcctgactatctggcggggaatggtgtggtttatcaaaccagtgatgtgaagtatgtgattgccaacaacaacttgtgggccagcccgttggatcaacagttgcgcaacaccctggttgccaacctgagtacgcaactgcccggctgggtggttgcctcccagcctctgggaagcgcccaggacacgctcaatgttaccgtaacggagtttaacggtcgctatgatggcaaggtcattgtcagtggtgagtggctgttgaaccaccagggacaactgatcaaacgtccgttccgtctggaaggagtgcaaactcaggatggttacgatgagatggttaaagtgctggccggtgtctggagtcaggaagccgcttctattgcacaagagataaagcgtctaccttaattataaagatttgtaaatataaccgtctccggtatgttgcctgaggcggtttttttgtctctaacgtgcggaaaaatttgttcctcttcacattttttgtacaaccgacatgcccgtgtagctcacaaatatgacagtggcgtgaattttgcgcattgacggcagttatgattcgcggtattgcttaactgtgattgcacatttagtaatcactgttttcttttccaccagaaaccagtatgagggaaacgaggcatgaagagacaaaaacgagatcgcctggaacgggcacatcaacgtggttatcaggccggcatcgccggacactcaaaagaaatgtgtccctatcagacgctgaatcaaaggtcacaatggctgggaggctggcgagaagccatggcggacagggtagtaatggcctgattctgtctctttaaaaagaaacctccgcattgcggaggtttcgccttttgatactctgtctgattataatcagaaggcagacgtatcctggaacagaccgactttcaggtcgctggcggtatagatcagacgaccatcaaccagcacttcgccatccgccaggcccataatcagacgacggttaacaatgcgtttaaagtgaatacggtaggtcacttttttcgctgtcggcagtacctgaccagtgaatttcacttcgccaacgcccagcgcgcggcctttaccttcgccgcccagccagccgaggtagaaccctaccagctgccacattgcgtccaggcccaggcatcccggcataaccggatcgccaataaagtggcatccgaagaaccacagatccggattgatatccagttctgcttcaacataccctttgtcgaagttaccacccgtttcggtcattttgaccacacggtccatcatcagcatgttcggtgctggcaattgcgggcctttagcgccaaacagttcaccgcgaccagaggcaagaaggtcttcttttgtataggattcgcgtttatctaccatgttctctgtaagccttattttattgaagcacgcaggatagctaacacgtgtacgctgaacaagtccgatcagttcggaataaaccagttcagccaacgtaatggccatggaaaacggtgacgtccttcctgttgcgatgcttgcgcgatacgttcctggatggtttgcatcagcgtcgtttggccttcgccatcccacaccagatttaataataacggcagtgcgtcagtcacatcgtctactgcccagatggtgaatttgccttcttctaccgctttcaccagttcactgtgaagacttaaatggcgaacgttagctgtggggataatgacaccttgtttcccggttaactcacgttgctggcaaatagcaaagaagccttcgattttctcatttaaaccaccgaccggctgggcgcgaccgaactgatcgactgaacctgtgatagcgatactctgattcaccggcacatcggcgagggcgcttatcagggcgcagagttcagccatcgaggcactatctccatcaacttcactgtatgactgctcaaatgtcagcgatgctgagaaggggatctgttgctcaagctgtagttccgacatcaggaacgcttgcatgatcatcatccctttcgcatggatattgccgccaagctccgctttgcgttcgatgtcggtgaattcaccatcgccaatatgcacaacgcagctaatgcgagaaggttcgccaaaagcgcgtggatgacccggaaattcaatgaccgaaagggcgttaatttgcccgatgcgttcgccttcggtttcaatcaggatttgctcctgaaggatctcatcctgcatacgttcagcgaggaaaccttcgcgccattcacgctgctgcagcattaagtttagctgctcgccggagaaggtgtcgccatcacacagggaggcgacctctttacactggcggaggatccactgcgggctaagcggaagtgtttcttgttcaccggtgtagcgtgctgcttcgcggataagtatcggccaggcatccgctcccggtgcaggtaagtgattatgtctggcggtaaatgtcacccagcgacaccactgggttactgactccgcatcgacaatctgcagagtatcttcaaattcgctataaatagcctgctctgaaagctctggctccatctcctggaaatcagccaatgattcgcgttcgcctaccagaatgactttcagcttcaatggcatcgaaggcacagagacggggagagggcgcgactcatcaaacgcaacccagtcaaaacgctcgcggttaacgatatttttcagccgcatccacagcagaggttgcgccagcagtgtacgcaaagagatgatgagaataccgccatttgcctgatgcaccagaccaggctgcagggtaatgtcgccattaaactggcgcaggcagccaaagagttgctccgcttctacccagtcggcagcgacaacttgcgttaaagtcgcaaaattatcatctgcactcactgcgtgacgtaagcggatggagtggccggaaacctcatagtgaccgcccaccagttggcctgcatcgctttgtagcgtacgcgcggcattggcaataagattcagatactcagactcttccggggccttcgccagcataaaagaggaggatgctcgcgtatgcagcaactgctccagcgcaaattgcagccgcggttgagtatcactgaataaaggatcgttttcgtcaatcaaatgtggctgagcaaatatttcctgatagctatcggtatcaggaaccaggtcacgccatgcaagtttcgtaatggtcaaagttgatgttttttagtctgttgtcaaagccgcgattataccgtaaccggcactacagcacacgtagaaagcaccgacaatactcctggcatgggcgttaaagctcacaggatggagattcttttcttcactggcctaaaaagctgatattctgtaaagagttacacggtaacattgagatcgctatgaaatatcaacaacttgaaaatcttgaaagcggttggaaatggaagtatctggttaagaagcatcgcgaaggggagttaatcacccgttacatagaagccagtgccgcccaggaagccgtcgatgtgttgctctcgctggaaaatgaacccgtgctggtaaatggctggattgacaagcatatgaatccggaactggtcaatcgcatgaagcaaaccattcgggcaagacgaaagcgccattttaatgcggaacaccagcatacgcgcaaaaaatcgatcgatctggaatttattgtctggcaacgtctggctggtcttgcgcagcgtcgcggtaaaacgctttctgaaacgattgttcagctgattgaagatgcggaaaacaaagagaaatacgcgaataaaatgtcttctctgaagcaggatctgcaggcattgctgggtaaggaataactgacgaaagtcagttcaatttactaaaggcaaaaaaaaccccgcagcagcggggtttttctaccagacgagaacttaagcctgcggctgagttacaacgtctttgatacctttaacttcgatctctacgcgacgatccggagccaggcagtcgatcagtgcagcacgctgtttcacgttgtcacaggtgttgccagtaaccgggttggattcgcccataccacgtgcggagatcttgtctgccgggatacctttggagatcaggtaatcaacaacagactgagcacggcgctcggacagaccctggttgtaagcgtcagaaccgatgcggtcggtgtaacccagaacaactacggaaccgtctttcggatccaggttgctcagctggctgtacagctgatccagagcagcctgaccttccggtttcagggttgctttgttgaagttgaacagaacgtcagacttcagagtgaagtgcttggtctgtacttccggtgccggagctggagccggagcaactactggagctgcttcgccctgaccgaaacggtaggaaacacccaggctcagcatgccgttgtccggacgagtgccgatggtgtgtgcgtcaccgatgttgttggtccactggtattccagacgggtagcgatttcaggagtgatcgcgtactcaacaccgccagcgaagaccggagaaacgccggtgtcgtggtttttaccataaacgttggatttagtgtctgcacgccataccataccacccagacgagtgtagatgtctaggtcgtcagtgattgggtaacccagtttagcggtcagttgaacgccctgagctttgtatgcaccgttttcaacgctgcctttgtacggcatacgacctaaccagtcgtaacccatttcaaagccaacatacgggttaacctggtaaccaccaaaagcaccagcgcccagttggttttcatgggtcgggccattgttgttgatgaaaccagtgtcatggtactgggaccagcccagtttagcaccagtgtaccaggtgttatctttcggagcggcctgcgctacggtagcgaaaccagccagtgccactgcaatcgcgatagctgtctttttcattttttgcgcctcgttatcatccaaaatacgccatgaatatctccaacgagataacacggttaaatccttcaccgggggatctgctcaatattaactctaccgatatcttcggcttatgccgagcacccctggcgatgtaaagtctacaacgtagttgaaaacttacaagtgtgaactccgtcaggcatatgaaaaaaaagtcttgtataaggtatgtttaatcttttttgtcagcgacaatttacagaagagaatcgcggaaaccgcttcagacaagcctccgcaaggaaaattagtcacgactgaaagcattggctgggcgacaaaaaaagttccaggattaatcctaaatttacttaatgatacaaattagagtgaatttttagcccggaaagttgtctcgtggcgtgagaggatgcgcttaccggacgcataataaaccccatagcgttaccttcatttgccgcatcaacaagttcagcatgctcttcttcagtcaaatcatctgccaaccaaccgatcaccacactgtaattgcccgtgcgtaaagcgcgaaccattgactccacagtgtggcaaggggagagctggctaatctgcattactttcgttaagggtagcccagatgcctgaacccattcccgactcagtttttgttgcggtgttaaccagagttgccagcgcgattgctgaccgagttgctgtaacaatggcaacagtagaagttgcgtcatcatgggctgatcttcgcgatagacaacttcactgataagcccggctgtagtgttttccgtagagacacgcgcaattttacttgctgcggatgagaacgacgaagaacgatgtgcatagcctgaagtgtacataatcaatccagcccctgtgagttactgtatggatgtacagtacatccagtgacaacaaagatcaaccctattttcggaaagagcctcgcaaattttgtcgttggtgacgggaaaacataaattaatcttgccccttaagaataagttgcctattttcgtagttaacggatccgttaatgtgaatcattcttttatgttatgattttaaaaggaattttatgaaaagcctctcctataagcggatctataaatcacaagaatacctggcaacgttgggcacaattgaataccgatcattgtttggcagttacagcctgaccgttgacgacacggtgtttgcgatggtttctgatggtgagttgtatcttcgggcttgtgagcaaagtgcacagtactgtgtaaaacatccgcctgtctggctgacatataaaaagtgtggccgatccgttaccctcaattactatcgggttgatgaaagtctatggcgaaatcaactgaagctggtgcgtctgtcgaaatattctctcgatgcagcgctgaaagagaaaagcacgcgcaatacccgggaaagactgaaagatttgcccaatatgtcttttcatctggaagcgattctcggggaggtggggattaaggatgtacgggcgttacgtatacttggggcaaaaatgtgttggttgcgactgcggcagcaaaacagtctggtgacagaaaagattctgtttatgcttgaaggtgccattatcggcattcatgaagctgcgctcccggtggcatgccgccaggagcttgcagaatgggctgactctcttacgccgaaacaggagtttcctgcggaacttgagtaatctggcgttgcagacgaccaatctcaggcagtaatgcaatcaataatccaacttgttgtacgaccagaggttctttgctgtctgcccgtggttcaagttgctgcatccgctgtttcaggctagctaatgcctcattgacgcgttcttcatcagcaggttgatgatgtaacgcgtcatcaacatagcaaactgcgtcatcaagaaacgccagaatttcaggattagttaactgctcccggtgagcaccgagggctgagatatagctggtaaacgtatggttaaggcacagcaaccgaaacgcggcttcgcgaatttgcggggtaacgttcggctcgctggacatatttgataccaccgacgccagctcagcatcacggttgtgtgcatcgcggcgggcaatacgatacgccagacggttatcacgcccctgatggtattgctccagtatggcatcgagataccgacagttggcctctgtggcgcgttcgagcatgcgcggcagattgcgaaactgccagtcaggccagatgtagctcactgccgcccacgcaatggcacaaccaatcagcgtatcgattacgcgaggtaacgctacttcaaaaccttcacccagtaagttaaaacacagtagcaccaaaagtgtgatgaacatcgttgcatgagcgtattgcacgttacggaaggcaaaaaagagcacgccggtaataaccagcagcaccagctgcccttccagtgatggcacaaaccacagcacaggaatgccaatggcgatacctaccagcgtaccaataatccttaacttcaggcggtggcgcgtggcgttatagtttggctggcagacaaacaaacttgtcagcaagatccaatacccgtgatgcattccggttatctgaatgatggcgtagccgaagcacaacaccagcgacattcttaccgcatgacggaagagggcggattccggcgtgaagtgacggctaagacgcagccagatatcactcaacccgtgcgggctgtcatcagcgagctcattttcgtcattattatggggtagtgcctgggcctgttctgattcaattgttgccagttgggcatcaatggcgcgtaaattgttcagcaaaaatcccagtgttttgagtaaatcggcgggtgcgccgttatcgcgcatccgctccagcgcagcatcaatatgcgtaaaagcgcgctcaaaatgcggatcatgttgataaggctgacgcaacaaaatacagcgtgacagttgctggcacgcctggccctgcatcgacatcagccgctgaaaacggaacagcacgtcgctgtggcgaaaatgttcacgcaatgtttgatactgaatatgagaagagctggcacgctcgtgaatatcctgtgcgacaaagtaataatgcagcgtgcgacgcgttccccgttgaccacgatcgccacgtaagcgggtcagcagcgagagtttcgtctgattcaatgtcgccatcagcagaccgttggcgagagccaaatcgtacagcggtgcctggctttgatcttcaatatcaggatcaaacatgcgcgacttgagctcaagataacgcgccagttgttcatagcaacgcgccaggttgtcctgcagcgggcggaccgggaacagcagatgaccaataagtgtcaggacgttgtaccagacggcaccggccagcagatacatcggctgctgataccagtgctcatacagtgatgttcccaacatagtgtaaatggcgatcagcaatgcaccgaaggcaattgttgcatagcgttgacccagaccgccgagcaaaatgaagccgctggtagagagcgttaagccaatcgcaaatagccagggccagggaaacagcaattctactgaggccgaggcgataaaaaagcagaacagcgtaatgatgaggttacgcaaacgtcccgccagtcggtcatcgagatcggtcagcgccgctgccaccatccccagcgttagcggaatcgtcagttttacatcacccagccaccacggaaacgctgtggttccacaaagcgcaataaaaatacgcgcgtaatacagccaggcgctgttccaggtatagcgtttgagcaaaggacttagcataaaggccatattagtggattattcaaaacgacgacgtgcattggcttcacgcgcagcttgcgctgtttctaccgataccacgcgacgaccaaccggccatagtgcaatagcggcaattttaaagttcgcaatgccgacaggaatgccaattattgaaatacattgtgcgatgcccgttgcaatgtgcatcaggcataaccaccagccaaagaaaatcagccagaaaatattcaataccgtaccgccagtattcagcagcacatttttgccagccgggttcagttcatcgacatgaatagcttcattgccataaggcaccagagacagtttagtgatctcccagcaggatcgtgtcagcggtaaggtaaaaatcagcacaatactgaccagagtcgccaacagccagcccagagtggtggcaaatccgccaagcacaaagttcagaatgttcaaaacggtacgcataaaacctcgctttactgtggttttcagtaatgggcggcaattgtaacgtttttttgggctggagcacgttttctctgacggttacactgataagaaataatttcgtgtggatctacagagtcatggaactgaaagcgacaacgcttggaaaacgtctggcacagcacccttacgatcgggcggtgatcctcaatgccgggattaaagtctccggcgatcgccacgaataccttattcctttcaatcaattactggcgattcactgtaagcgcggtctggtatggggcgagctggaatttgtactgccggacgaaaaagtggtgcgtctgcacggcaccgaatggggcgagacgcagcgtttttaccatcatcttgatgctcactggcggcggtggagtggcgagatgagcgaaattgcgtctggtgttttacgccagcaactggatttgattgccacgcgcactggagaaaataaatggctgacgcgtgagcaaacctctggcgttcagcaacaaatccgccaggctttgtcggcgttgccgttgccggttaaccgactggaagaattcgataactgccgtgaggcgtggcgtaaatgtcaggcctggttgaaagatattgaaagcgctcggttgcagcataaccaggcgtataccgaagccatgcttaccgagtatgcggattttttccgccaggtcgagtcttcaccgctgaatccggcgcaggcccgggcagtcgttaatggcgagcattctctgttagtgctggcaggtgcaggaagcggaaaaacgtcggtgctggtggcccgtgcaggctggttgctggcgcgtggtgaagcgtcccctgagcaaattttattgctggcgtttggtcgcaaagccgctgaagagatggacgagcggattcgcgaacggctacataccgaagacattaccgcacgcacgtttcatgcgctggcgctgcatattattcagcagggcagcaaaaaagttccgatagtcagcaaactggaaaatgataccgctgcccgtcatgaactctttattgctgagtggcgcaagcaatgcagcgaaaagaaagcgcaggcgaagggctggcggcaatggctgacggaagaaatgcagtggtcagtgccagaaggtaacttctgggatgatgaaaaattacagcgtcgccttgcctctcgcctcgatcgctgggtaagtctgatgcggatgcacggtggtgcacaggcagaaatgattgccagtgcacccgaagagattcgcgatctgttcagtaaacgtatcaagttgatggccccgttattaaaagcctggaaaggtgcgctgaaggcagaaaacgctgtcgatttttcgggccttattcatcaggcgattgtgattctggagaaaggtcgctttatcagcccgtggaagcatattctggttgatgaatttcaggatatctcgccgcagcgggcagcgttgttagcggcattacgcaagcaaaacagtcagacgacgttgttcgctgttggtgatgactggcaggcgatttaccgattcagcggtgcgcaaatgtcgctcaccaccgctttccatgaaaactttggtgaaggcgaacgctgtgatttagacacgacttaccgttttaacagtcgtatcggtgaggtggcaaaccggtttattcagcagaacccaggccagctgaaaaagccgctaaacagcttaaccaatggagacaaaaaagccgtcacgttattggatgagagtcaacttgacgctttgctggataagctctctggttatgccaaaccggaagagcgcattctgatcctggcgcgttaccatcacatgaggcctgccagcctggaaaaagcggcaacacgctggccgaagttgcaaatcgactttatgaccattcatgccagcaaagggcaacaggcggattacgtcatcatcgttggcttgcaggagggaagtgatggttttccggctgcggcgcgggagtcgattatggaagaggcgctactgccaccggttgaggatttcccggacgctgaagaacggcggttaatgtacgtggcgctgacccgggcacgccatcgggtatgggcactgtttaacaaagagaatccctctccctttgtggaaatactgaaaaatctggatgtgccggtggcgagaaaaccgtaagaaacaggtggcgtttgccacctgtgcaatattacttcagacggtccgcgagataacgctgataatcggggatcagaatatcgaccgcgtcgttgaaatgcggcgactggattatgaagtctgccgttgccacgttggtggcgaccggaatgttccataccgtcgccagacgcagcaaggctttcacgtcaggatcgtgcggcacggcatttagtggatcccagaagaaaatcaatacatcaattttcccttctgagatcaatgcgccaacctgctggtcaccccccattgggccactcaacatcgcgttgacgttcatgccggtcgcgcgggaaattaagttaccggtagtgcctgttgcatacagtacgtgttgttccagtaacggttgatgccgttccacccagctcatcagcatttgtttgcagtgatcgtgtgccaccagcgcaatatgtttccgcgcaggtaaagtgcgagtcgtcagttccataatgtacatccgtagttaactttcctacagattactgtaagcacttatcgctgcaagataaagaccgaaaaagcctgcgcacaggcacaaaaatctcaggaagatggttgtttttccgcccactgcaggaaagtatttcgcgtttgtgggtcagccagtttaaaccaatacttcagccgttgttctgtgagcacctgagactgcggtggaatagcatccagctcggaaacacccgaaagcagcgtactgtcatctgccatcatcgtggcaaattgcggtagtgaagcgcgtttcgcggatttgttatagcgttcaacctcgacctcataatcaatcgtttttgccgttgaggtaatggcgagaatatccagctttaccggaattggcgtcgcatcgccatccaacaattcaaggtgcggcgcggcatcaaaatggttagcttcccgctcattctccaggcgaggcaggcgaaaattgacctggttgatgagctgggtattaaaactgaccaccagcggtggggagatatacagccgttcttcactattggaaagatgaatcgtcttctcaacgcgaaacactaactgatgcggtccattatccagttcaatgctgtccgcaccgcgcagcagagagctggaaaccttcttgccgtcgagtaccagaagatcgacatcggttgaaagccgcagcgtggtggcaaaaacggataccggcaaacataatgcaatcaaggtggtcacgatgccggttttcataggtagctcctgtcaaaagaccgcccgaataataatgtgtcaaaatttttctttaatcatacttactaacatatagacatatttcccgcttttgctctcattcattcgtattagctgcatggttggcatgtcggctttgtcgtacactttgttaaacagtctggaggaaataatgaaagaaaccgatattgcaggtattttaacgtccactcacaccattgcgctggtgggggcaagcgacaaacccgatcgtcccagctatcgcgtgatgaaatatctactcgaccaggggtatcacgtcattccggtttcgccaaaagttgccggcaaaacgctgctgggccagcaggggtatggcacgctggcagacgttccggaaaaagtcgatatggtcgatgttttccgtaattcagaagctgcgtggggcgtggcgcaggaagctatcgccattggcgcgaaaaccctctggatgcaactgggggtgattaatgagcaagcggcagtactggcacgggatgccgggttaaatgtggtgatggatcgctgcccggctattgagatccctcgcctgggcctggccaaataaaaaatccccggaaggcaaaaaccttccggggattcgttcagggatcagttacgcagacgcggggcctggagttgtttgcggatggtctgcgccagctcatccatggatggctgttcaggatgttcatcctgcaattcgctacttagctgggcttcagccaggtaggtatgaaccggtaggccgttatcgtcctccatcaccacgtgataccacggagcggcgcgaagctcgtcattcaccgccagctcatcaggcgacggttcagagagcgaataaaccgggtcgatatccacgaccactccgagataacctaacagggaatggcggacctgctggccgataccgaatttgctggcaatcatagtcacctcccgggaaatctttacctttgatataagggtaaaattccacatttcaagttacatgacgcgacaggcaaaccctttcagatatagcccttccgggtaggtagcgatcaccggatgatcggctgcctgacggaactgctctataaattgtacatcacggccggcatcaattgcggcatccgcgatgattttctgaaataaatcgctggtcatcagaccggaacaggagaaagtcaggagaataccgccttcattcagcaactgaatcgccagcatgttgatatctttatagccccgacacgcgcccatcaactggcttttattctcaacaaacttcggcgggtccatcacgataacgtcaaatttttcaccgcgatcgcgataagtacgcagcaatttaaagacatcatcacggacaaactcagccttgctcagatccagtttgttcagctcaacgttctgccgtgcaatatccagcgcttcctgggaggtatcaacgctgacaacctggctgcaaccgcccatcagtgccgatacggcgaaaccaccggtataggagaaacagttcagcacacgtttattttcaacgtagcggcgggtagccaggcggctatcacgctggtccaggtagtagcccgttttgtgtccgtgctgaatatccaccagcagtttcattccgtgttcttcaatcggcagcagggcaggtggcaactcgccggtgacggggccctgggtcagctccattccttcttttttacgtaccgcgacgtcgctgcgatcgtaaatcgaacattccgggtacagcgtttgcagggcactaattaatgccgcgcgctgatattctgccccagcactcagcagttgcagcaccagaaaattaccgaaacgatcgatagtaatacccggcaggccatcagattctccggcgattaaacgatagctgtcgaggccatctttttgcgccagccagtcacgccatttttgtgcttgttgcaaacggcgggaaaaaaaagcaatgtcgatagactcagacgggtcaaacgtccagacgcgcgcccggatttgcgaagctggcgaataagcgccgcgtgctaaccattttccctgatgatcaacaatatcgatggtttcaccgaggctggctttaccttccatgcgggcaacggccccggaaaagacccacggatggcgacgaagtaatgatttttcgcgccctttggctaacactaaacgtacactcataatttacttttctgtcgatgcaaagaaatgggcgtcattgtccggagttttccatggatttgcaacgcgtccattaaggataaggagagcagcaatgtcgaaagtctgcataattgcctgggtttacgggcgagttcagggcgtaggatttcgctacaccacacagtacgaagcgaaaagactgggtttaaccgggtacgccaaaaatcttgacgatggcagcgtggaagtggttgcttgcggtgaagaagggcaggtggaaaaattaatgcagtggttaaagagtggcggcccgcgttctgcgcgtgtagaacgggtgctcagcgagccgcatcatccctcgggggaattaaccgattttcgtatccgttaaatacattttaccggttttggcaggccagcaattttggtggcttgcttagccggacctttcggaaacagtcggtataaatagcggctgttacctttttcttcgccaaatttattcgccatcgcttttaccagcatacgaatcgccggagaagtattgaattccagatagaaatcacgcacaaaacgcaccacttcccagtgttccggtgacagcgaaatcccttcgttctctgcaatcaccacagccagcggctcactccactggctgctttctttgagatagccttcggtatccgtttctatctctttaccttcgaagatcagcataattattactaccttaatcagactggcggcagtgtaacaaaaaacaaagccccgcataaagcgaggctatgaaagtgttagcgggtgagattaatcgcggctagcgaagcccagaatgctcagcaggctgacgaagatgttgtacagcgaaacatacaggctaaccgtggcacgaatatagttcgtctcaccgccatgaatgatgttgctggtttcaaacaagatagcgccagaggagatcagaatgaagaccgcgctgatcgccagatgcagagcaggcagctgcaggaagatattcgcaaccataccaatcagcaccaccacaatacccgccatcagcataccgccgaggaacgacatatctttgcgggtggtcagcacatatgcagagcagcagaagaacactaacgccgttccgcccagtgccatagcgattacgtcacccattccggcagacagataggtgttcagaataggtccgaggatataacccagaaaaccggtaaaggcgaatgcggagataatcccggtcggcttattcgccgttttataggtcaggaacatcaaaccatacatacccaccagcgtcagaatcagacccggagatggcagcatcagcaccgtactggcagttgcggtaatcgccgaaaaggccagcgtcaggctcagcagaaaataggtattacgcagcaccttatgggtgctaagcagtgatgtacggtcatgtgaagaactaacaatacgatccattgagtcactctctatgacagatgtaattaattaagcagcataatgataatgcgtaagggcacccagaagttttacccatctttacgcatttgatctggaacaggtttaacagcggattatcaggtcattaagcaaatataacgccctgagaatttcgacaggcaaaagaaaaaggggttagcatttagctaaccccttatcttatttggcggaagcgcagagattcgaactctggaaccctttcgggtcgccggttttcaagaccggtgccttcaaccgctcggccacacttccggaatgacgcgcactataaacatcccgatgcggcgtgtaaacccctaatttgtttgtttgcctgaaaaacagccaaaagtgcattgatagcgtgaaataacagcagattgatcatttcatcaccatgaattccttctcttttactcgtttagcaaccggctaaacatccccaccgcccggccaaaagaaaaataggtccatttttatcgctaaaagataaatccacacagtttgtattgttttgtgcaaaagtttcactacgctttattaacaatactttctggcgacgtgcgccagtgcagaaggatgagctttcgttttcagcatctcacgtgaagcgatggtttgccttgctacagggacgtcgcttgccgaccataagcgcccggtgtcctgccggtgtcgcaaggaggagagacgtgcgatatgaataacgaggaaacattttaccaggccatgcggcgtcagggcgttacccggcgcagctttctcaaatattgtagtctggctgccacgtcgctgggattaggcgcgggaatggcaccaaagattgcctgggcgctggagaacaaaccgcgcattccggtggtatggatccacggtctggaatgcacctgctgtaccgaatcttttatccgctccgctcacccactggcgaaggacgtcatcctttccctgatttccctcgattacgacgatactttgatggctgccgccggaacccaggcggaagaagtctttgaagacatcatcacgcaatacaatggcaaatatatcctcgcagtagaaggtaatccgccgctgggcgagcaggggatgttctgtatcagcagcggtcgaccgtttattgagaaactcaaacgtgccgctgccggagccagcgcgattatcgcctggggaacctgcgcgtcctggggctgcgtgcaggccgcgcgacccaatccgacgcaggcaacgcctatcgacaaagtcatcaccgacaaacccattatcaaagtacctggctgcccgccgatcccggatgtgatgagcgccatcattacttacatggtgacctttgatcgcttgccagatgtcgacagaatgggccgtccgctgatgttctatggtcagcgaatccacgataaatgctatcgccgcgcccacttcgacgccggagagttcgtccagagttgggatgatgacgctgcccgcaaaggttactgcctgtacaaaatgggctgcaaagggcctaccacctataacgcctgttcctccacacgctggaatgatggcgtttctttcccaatccagtctggtcacggctgcctgggctgtgcggaaaatggtttctgggatcgcggttcgttctacagccgcgtggtcgatattccgcaaatgggtactcattccaccgccgataccgtcggtttaaccgcgcttggcgtggtggcagcggctgttggtgtgcacgcagtcgccagcgccgttgaccagcgcagacgtcataaccagcaacctacagaaaccgaacatcagccaggcaatgaggataaacaggcatgagcactcagtacgaaactcagggatacaccatcaataatgccggacgccgcctggtggtcgacccgattacgcgcatcgaaggccacatgcgctgcgaagtgaatattaacgatcagaatgtgatcaccaatgccgtctcctgcggcaccatgtttcgcgggctggagatcatcctacaagggcgcgacccgcgcgatgcgtgggcgttcgttgaacgtatctgcggcgtctgtactggcgtacacgccctggcttcggtttacgccatcgaagatgctatcggtattaaagtgccggacaacgccaatatcatccgcaacattatgctggcaacgctctggtgccacgatcatctggtgcacttctatcagcttgccgggatggactggatcgatgtgttagatgcgctgaaagccgacccgcggaaaacctccgaactggcgcaaagtctctcctcttggccgaaatcatcccctggctatttcttcgacgtacaaaaccgcctgaaaaaatttgttgaaggcgggcagttggggatcttccgcaatggctactgggggcacccgcagtacaaactgccgccagaagctaacctgatgggctttgcccactatctcgaagctctcgatttccagcgtgaaattgtcaaaatccacgcggtctttggcggtaaaaacccgcatccaaactggattgtcggcgggatgccttgcgccatcaacattgacgaaagcggcgcggtcggggcagtcaatatggaacgcctgaacctggtgcagtcaattatcacccgcacggcggacttcattaacaacgtgatgatccccgacgccttagccatcggtcagttcaacaaaccgtggagcgaaatcggcactggtctttctgataaatgcgttctcagctacggcgcattcccggatattgccaacgactttggcgagaaaagtctgctgatgcctggcggcgcggtgattaacggcgacttcaacaatgtgctgccagtggatttggttgatccgcagcaggtgcaggagtttgtcgaccacgcctggtatcgatatcccaacgatcaggtcgggcgtcatccgttcgatggcatcaccgacccgtggtacaaccccggcgatgtcaaaggcagcgataccaacattcagcagctgaatgaacaggaacgctactcgtggatcaaagcgccacgctggcgcggtaacgcgatggaagtggggccgctggcgcgcacgttaatcgcttatcacaaaggcgatgctgcgaccgttgagtcggtcgatcgcatgatgtcggcgttgaacctgccgctttccggtatccagtcaacgttaggccgcattttgtgccgcgcgcacgaagcgcagtgggccgcaggtaagttgcagtatttcttcgacaagctgatgaccaacctgaaaaacggcaatctcgccactgcttccacggaaaaatgggaacctgcaacctggccgacagagtgccgtggtgtcggttttaccgaagcgccgcgcggggcgttaggccactgggccgccattcgcgatggcaagattgatctctaccagtgcgtggtgccgaccacctggaacgccagcccgcgcgatcccaaagggcagattggcgcttatgaagcggcgctgatgaacaccaaaatggcgatccccgagcaaccgctggagatcctgcgtactctgcacagctttgacccgtgcctcgcctgttcaacacacgtgctgggcgacgacggtagcgagctgatctccgtgcaggtgcgttaacagcgaaggagaatcatcatgcaacagaaaagcgacaacgttgtcagccactatgtctttgaagcgccagtgcgcatctggcactggttgacggtgttatgcatggcggtgttgatggtcaccggatactttatcggcaagccgctaccttccgtcagcggcgaggcgacgtatctgttctatatgggctacatcaggttaattcacttcagcgccgggatggtttttaccgtggttttgctgatgcggatctactgggcttttgttggcaatcgatactcccgcgagctgtttatcgtgccggtatggcgtaaaagctggtggcagggcgtgtggtatgaaatccgctggtatctgtttctggcaaaacgtccgagtgccgatataggccataatcccatcgcccaggcggcgatgttcggctatttcctgatgtcggtctttatgatcatcactggttttgcgctgtacagcgaacacagccagtacgctatttttgcgccgttccgttatgtggtggaatttttctactggacgggtggcaactcaatggacattcacagctggcatcggctggggatgtggctgattggcgcgtttgtgatcggtcatgtctacatggcgctgcgtgaagacatcatgtccgacgacacggtgatctccaccatggtcaacggctaccgtagccacaaatttggcaaaataagtaacaaggagcgttcatgagcgagcaacgcgtggtggtcatggggctgggcaacctgctgtgggccgatgaaggcttcggcgtgcgggtggcggaacggctgtatgcccattaccactggcccgagtatgtggagattgtcgatggcggtactcagggactgaacttgctggggtatgtcgaaagcgccagccatctgttgattctcgatgccattgactacgggctggaacctggaacgctgcgaacctatgccggagaacgcattccggcttatctcagcgcgaagaaaatgagcctgcatcagaacagtttctccgaagtgttggcgctggcggatatccgcggacatctgccagcacatattgccctcgtcggtctgcaacccgcaatgctcgacgactacggcggtagcctgagcgaactggcacgggagcaactgcccgctgcggaacaggcggcgctggcgcagcttgctgcgtggggaattgtgccgcaaccggctaatgaatcgcgctgtctcaattatgactgtctgtcgatggaaaattacgaaggcgttcgcttgcgccagtaccggatgacacaggaggagcagggatgagcaacgacacgccatttgatgcgttgtggcaacgaatgctggcgcgcggctggacgccagtcagtgaatcccgtcttgacgactggcttacgcaagcgccagacggcgtggtgttattaagcagtgacccgaaacgcacgccagaggtcagcgataatccggtaatgattggcgaattactgcgcgagtttcccgactatacatggcaggtggcgattgctgaccttgagcagagcgaagccatcggcgatcgctttggcgtctttcgctttcctgccactttagtgtttaccggcggaaactatcgcggcgtgctgaatggtattcacccgtgggcggaactgataaacctgatgcgcgggcttgtcgaaccgcagcaggagcgtgcctcatgagcgaaacttttttccatctgctggggccaggaacgcaaccgaacgatgacagtttcagcatgaatccactgccgatcacctgtcaggtgaatgatgaaccgagtatggcggccctggagcaatgtgctcacagcccgcaggtgattgcgctgttaaacgagttacaacatcaactaagcgaacgccaaccgccgttgggcgaggtgctggcagtcgatctgttaaatctcaacgccgacgatcgtcactttatcaatacgcttctcggggaaggggaagtgtcagtgcgcattcagcaggctgacgacagtgaaagtgaaatacaggaggcgatcttctgcggattatggcgggtgcgcagacgtcgcggcgaaaagttgctggaggacaaactggaggctggctgcgcgccgctggcgttgtggcaggcggcaacgcaaaatctcttgccgacagattcgctgttaccgccgcccattgatggcctgatgaatggcctaccgttggcgcatgagttactggcacatgtacgtaaccccgacgcgcagccgcacagcattaatctgacgcaattacccatcagcgaggctgatcggctttttctctcacgtctctgtgggccgggaaatattcagattcgtaccattggctatggcgagagctatatcaacgccacggggttacgccatgtctggcatttacgctgtacggacaccttaaaaggcccgttactggaaagttatgaaatctgcccaataccggaagtggtgctggcagcgccagaagatttggtcgactctgcgcagcggcttagcgaggtatgtcagtggctggcggaagctgcaccgacgtaaaaagacggtaagtatcgctttcagtcttatgaatatcgcaatcggcgaatacctctggtcgtagagtttcaggataaagagggagatctaccattatcgggttatttttctctcttcgcctacaggagtgcgcatgtgggatgtcattgatttatcgcgctggcagtttgctctgaccgcgctgtatcactttttatttgtaccccttaccctggggctgatttttttgctggctatcatggaaaccatttacgtggtcaccggcaaaacaatctaccgcgatatgacgcgcttctggggtaagctcttcggtatcaattttgctcttggcgtggctaccggcctgaccatggagtttcagtttggtactaactggtcattctattccaactatgtgggcgatatttttggcgcaccgctggcgatggaagcattaatggccttcttcctcgaatccacctttgtcgggctgttcttcttcggctggcaacggctgaataaataccagcacctgctggtgacgtggctggtggcgttcggttcaaatctctctgcgttgtggatattgaatgccaacggttggatgcaatacccgaccggtgcgcattttgatatcgacaccctgcgtatggagatgaccagcttcagcgagctggtctttaatccggtcagccaggtgaaatttgtgcacaccgtaatggcgggctacgtgaccggggccatgtttattatggcgatcagcgcctggtatttactgcgcggacgggagcgcgatgtcgcattacgctcgtttgccatcggttccgtcttcggtactctggcgattatcggtaccctgcaactcggagacagttctgcgtatgaagtcgcgcaagtacaaccggtaaaactggcggcgatggaaggggagtggcaaacggaacctgcacctgcaccgttccatgtggttgcctggccggaacaggatcaagagcgtaacgcctttgccctcaaaattcccgcgctgctagggatcctcgccactcactcattagataaacccgtgccgggtctgaagaatttgatggctgaaacctacccacgcttgcaacgcggacgtatggcctggctgttaatgcaggaaatatcgcaaggcaatcgtgagccgcatgtgttgcaggcattccggggactggaaggtgacctgggctacggcatgttgctctcccgctatgcgccggatatgaatcatgtcacagccgcacagtaccaggcggcgatgcgtggcgcgatacctcaggttgcgccggtattctggagtttccgcatcatggtgggctgtggttccctgctgctactggtgatgctgattgcgcttgtccagacgctgcgtggcaaaatcgaccagcatcgctgggtgctgaaaatggcgctctggagtttgccgttgccgtggattgcgattgaagccgggtggtttatgaccgagtttggtcgtcagccgtgggcgatacaggacatcttaccgacatactccgcgcactccgctttaaccacaggacaactggctttctcactgatcatgatcgtagggctttacaccctgttcttaatcgccgaagtctacctgatgcagaaatatgcccgtctggggccgagcgcgatgcagagtgaacaaccgacgcagcaacaggggtaaaggagaaaatcatgtttgattatgaaacattgcgcttcatctggtggctgctgattggcgtgatcctggtggtctttatgatctccgacggatttgacatggggatcggctgtctgctgccgctggtggcgcgtaatgatgatgaacgccggatagtgataaacagcgttggtgcacactgggaaggcaaccaggtctggttgatcctcgctggtggggcattatttgccgcctggcccagagtgtatgcagcggcgttttccggcttttatgtggcgatgatcctggtgctgtgctcactgttcttccgcccgctggcctttgattatcgcggaaaaatcgccgatgcacgctggcgtaaaatgtgggacgccggtctggtcatcggcagtctggtgccgccggtagtcttcggtatcgccttcggcaacttgttgctcggcgtgccgtttgccttcacaccgcaattacgcgtggagtatctcggcagcttctggcaactgctgacgccattccctttattgtgcggattgctcagccttgggatggtgattttgcaaggtggcgtctggttacaactgaaaactgttggtgtgattcatctgcgttcacagctggccaccaaacgcgctgcactgttggtgatgctgtgctttttgctggcgggttactggctgtgggtcggtattgatggctttgtactgctcgcccaggatgctaacggtccttccaatccgttaatgaaactggtggcagtgctacctggtgcctggatgaataatttcgtcgaatcgcccgttttgtggatcttcccgctgctggggttcttctgcccattgctgacggtgatggcgatttatcgtggtcgcccgggttggggatttttaatggcgtcattgatgcaatttggcgtgattttcacggcaggcatcacgctgttcccctttgtcatgccgtcaagcgtgagtccaatctccagcctgacgttgtgggacagcacttccagtcagctgacgctgagcattatgttggtaatcgtgctgatatttttgcccattgtgttgctctacactctctggagctactacaaaatgtggggacgcatgacaacagaaactctccgccgtaacgaaaacgagttgtactaaggagcaggaacaatgtggtatttactttggttcgtcggcattttgttgatgtgttcgctctccacccttgtgttggtatggctggacccgcgtctgaaaagttaacgaacgtaggcctgatgcggcgcattagcatcgcatcaggcaatcaataatgtcagatatgaaaagcggaaacatatcgatgaaagcgatcttaatcccatttttatctcttctgattccgttaaccccgcaatctgcattcgctcagagtgagccggagctgaagctggaaagtgtggtgattgtcagtcgtcatggtgtgcgtgctccaaccaaggccacgcaactgatgcaggatgtcaccccagacgcatggccaacctggccggtaaaactgggttggctgacaccgcgcggtggtgagctaatcgcctatctcggacattaccaacgccagcgtctggtagccgacggattgctggcgaaaaagggctgcccgcagtctggtcaggtcgcgattattgctgatgtcgacgagcgtacccgtaaaacaggcgaagccttcgccgccgggctggcacctgactgtgcaataaccgtacatacccaggcagatacgtccagtcccgatccgttatttaatcctctaaaaactggcgtttgccaactggataacgcgaacgtgactgacgcgatcctcagcagggcaggagggtcaattgctgactttaccgggcatcggcaaacggcgtttcgcgaactggaacgggtgcttaattttccgcaatcaaacttgtgccttaaacgagagaaacaggacgaaagctgttcattaacgcaggcattaccatcggaactcaaggtgagcgccgacaatgtctcattaaccggtgcggtaagcctcgcatcaatgctgacggagatatttctcctgcaacaagcacagggaatgccggagccggggtggggaaggatcaccgattcacaccagtggaacaccttgctaagtttgcataacgcgcaattttatttgctacaacgcacgccagaggttgcccgcagccgcgccaccccgttattagatttgatcaagacagcgttgacgccccatccaccgcaaaaacaggcgtatggtgtgacattacccacttcagtgctgtttatcgccggacacgatactaatctggcaaatctcggcggcgcactggagctcaactggacgcttcccggtcagccggataacacgccgccaggtggtgaactggtgtttgaacgctggcgtcggctaagcgataacagccagtggattcaggtttcgctggtcttccagactttacagcagatgcgtgataaaacgccgctgtcattaaatacgccgcccggagaggtgaaactgaccctggcaggatgtgaagagcgaaatgcgcagggcatgtgttcgttggcaggttttacgcaaatcgtgaatgaagcacgcataccggcgtgcagtttgtaatgcataaaaaagagcattcagttacctgaatgctctgaggctgatgacaaacgaagaactgtctaatgcgtagaccggaaaaggcgttcacgccgcatccggccactttcagttttactctttctcggagtaactataaccgtaatagttatagccgtaactgtaagcggtgctggcgcgtttaatcacaccattgaggatagcgcctttaatattgacgcctgcctgttccagacgctgcattgacaaactcacctctttggcggtgttcaagccaaaacgcgcaaccagcaggctggtgccaacagaacgccccacgaccgcggcatcactcaccgccagcatcggcggcgtatcgacaatcaccagatcgtaatggtcgttcgcccattccagtaattgacgcatccgatcgcgcatcagcagttcagacgggttaggtggcacctgaccgcgagtaatcacatcaaagcctcctttgccaaaatgctggatcactttgttgagctcatctttacctgccagatattccgacaagccatgttcattactcacggtaaacaggttatgcgaataaccacggcgtaagtcggcatcaataaataacactttttgatcggactgggcgatcaccgctgccagagttgaactgacaaacgttttaccactgtctggcgtcgcaccggtgatcatcagaatgttattctccgtctccatcatagcgaaatgcagactggttcgtagcgcacgtacggcttccacagcagaatccgccgggttatccaccgccaggaaggggatatttttagtacgatggcgctgctgattagaaaataaatttttcttacgcagacgggtgcgtttatccagccactcggacattgggatagtggcataaacgctgatgccgtgctcttccagttgttccggggcttctacaccacgacgcaacatcgcacgcgccagcacggcacccacagaaataaacaggccaagaataaaaccaagcaccacgttcaacgcttttttcggtttcactggctgcggctgagtgactgccgggtcgataatccgcacgttaccaatggcactggatttcgaaatactcaactcctgctggcggttaagtaattgcagatataccgcacggcccgcttctacgtcacggcttaaacgtaacacttcctgttgagtggaaggcattgccgatacccgcttattcaggcgtttgcgttcttgctccagcgtctggcgtttttccagcagcgcacgataagttgggtgatctttcttatacagctgggagatctctgcctcgcggaaggtcagctcattgagttgattatcaacgttcacaatctgctcaagaacggctttggcttccaggttaaggtcaaccgaatcgcgctgctggcgataaacgttgagtttttcttccgcctggtccagctcgctgcgcacttcaggtaactggcgctgtaagaattcaaggctttgtgaatcctgcgccgcctggcgagcgatattctgttgcaaatagttgttagcgatgctgttcagaatacgagtaatcaactggggatcatcaccagtcatggtaagttccagcatcccgctttctttactgcgttcgctaacggtaaaggtttcctgcaatgcgttaatcgcttccagttcggtacgctggctcaggacaaactgtgttcctggtttggccttaatgtccgcgatagtcagcgcaacgccatctttttccagacgctggccgaccataccattgacggtgaactcttcaccttccagcgtatagtggccgttttccccaaccgtgagtgtcagttgctgatcctgaccattcagttgtggaatatgcatccagctgatcgccagctcacctggtttctctttggttaatctcgcccagccgcgacccacaatcggaaaatacttctgctcaaccatgtcgcgcagattcagttcagcaatggttttaccgagaatcatgcgcgattgcagcagttggatctccggtgcagactcgggcgatgagttagggatcatatcgctcaggccactgagaatggcgttgccctgtttctgctcaacctggaccagagtatctgcctgataaattggcgtgcttaacagcgagtaagcgacagcgatcagcgtgaataacgcggtcacgctgataataaacttacggtgatcccataactcgccgaccagacgaagcagatcgatctcattttcctgagtgctgcctggtggcgtattcatatttttagttgtcatcgtatcttataaactcaaattaccggctgaggcgcttcgcccattcctgactggcgcgctccaacataccgtagacatgttcaaatgcgtcctgacttttacgatagggatcagggatctctttctgttccagccattgcccaaacagcattgtcttcccgcggacctcgggagcgattgcggtaacctgagcaatatgttccgactccattgccagaatcagatcgtaatttcgtgccatctcagcagtgagcttacgtccggcatgtccttcaagagatacgccatgattagcggcaacatctgctgctgtcgcatctgcagggtgttttaccagaccatgaacacctgccgatttgacttttacgcctggcagacgtttacgcagcaagcgctcgccaatgggcgaacggcaaatgttgccggtacaaaccaccaggattgagttaaattttagttgggccatgtttgaatccaccgtgaagtctctgtcaggtcatgcaccccggaaatcgtcggtaccagcagagaaatcacacggttccaacgagccagcggcgcagtagtgacataaacaatgtcgtaaggttcaagctggaattccgttccgagtatcattgccgatgcgtccttcgcattcagctgataaatattggcgattttgccattctgcttgttttgcgttgcacgaataacaaaaatccccgtcgcatcagcgacatcctgattcataccctcagcgttacccagcgcttccgccagggtcataccgctgcggtccattttcagcgtgctctgtttacccacttcacccatcacgaagactttcagatcatcgttgcgcggaataaataaaatatcgcccgggtgcagcagtttgttctggcgcaagtcgccacgctgcatcagcgcatagaggttcactttggtctttacgccattctgggtgagcaccacgttgcgccagtctgcatctgcggtcagcccccccgcggcgttaatcgcatccatgatggtcagaggaatattggtaatcggctgctgacccgatttgctgacttcgccggtgacgtacgctttttgcgagcggaacgccgcgacgctgacatcgacttgcgggctttcaatgactgaatccagacgcgctgtaatctcgttgcgtacctgggtaagtgttttcccggccactttcaggcgaccaatataggggtagaaaatcgcaccatcggcgttaacccagttgccggtatcactggcgctacggtattgccctgcgggggtggttagttccgggtgatcccagaccgtaatcatcaacacatccccaatgccgatacgatattcatagttcgcgatttgctgctccagctccgggttagcctgcgacataatcggtttggcgcgcagctgatcaatcaatcctggcgtgacgggatagatattgaccattttgtccaggtcatactgattgtcaggtagttcaatgacatccttgttactggtcgataaattctgaccaggaacaagggtacatgctgtcaaagacagaacagccaatgtcagtaccgaaaacttaaaaattttctttttcattggtttatatttatcagtcattgtaatgttatgaattacgtcaggttattgtccaaccggtacttctcgctctgccgtcattggatagagctggtatttgcgtgacagcatttgtccaccatcacgcgtcaatggtgtccacgaaaccaccgcgcggttgcggttaggtccaatggtcatcaagtcgaatggaatcgagatataaaaacctttactaaagccgccttcgccgtagtcatctttagatacgttactgattgccgcccatacccctaccgccacgccgctgtcaaagcgtttggcgacgtcgatcgttgcgcctttatcttttgccagatattgcccaacgctaagtttcatcagtacgccattgagcgtcggcgggttccagtaagccgtcacgaaacctgttggcgtggaataatcggtgaaacgcatcatgttgtcccagtcacgctgcttcacgtagttaacgtccacacccagcgcccagctggcatctagcgggcgataaagcagctcggaaccgacaccggcatacatcgtttccagataaccgccatacacctggccatagaaaccattgcctaagtcagcaaaatagttcgcctgcaagttgttgagataaacgtcattgcgaacgtagtcacggatatgcgtgcgcacgcggggcagggtagagtccgcgggcaacagcgaagacttaaacttgtcgtagttgttgtaaatattggtgaaaataccgccatcaagcagcaggtggtcggtaaaccagtagcgggcactggacatcagccccagctggaacatatagaaatcttccgggccgcccagcgactgtgaaagtgttgggttgaaagagtagctaaagcgatcttcacgaatacggtagcctcgaccaaaggcagaaagatcttcagcttcaacacgttgttgttgcagtggctctgattgaccaggcgctgtacctgccagctgtttgcgcaggctggctacgtcggtttcggtagtcaccatcgccatatgctcgcgcttttgcgtcacgctaatcttctcaacgccttgcggcaggttattcaccagaatccggttggcacgatcgaccgcttcacgagagtcacggtatttgtattgctgaccagacatatacagtgtcttatcgcgtagctgaatttctggcgcgtcaaagcccgcgttatacttcagggcggtaagttggtttgctaccgtggtgtactgcaatccttcagattcaggcgcaggttgatatgccggttttggcgtatcgcgcagggcagggcgcagatcgttgaaattggtccgtaacgtgaagccaaacatcaacgtgttaccgcgttcataactcaggttgagatctgcctagctggcagcgcgataaactgcgccgacgttgaaatggcttgcctgaggcagtttgccagcgaaatcattctggtaattgtttccatcgtattcgagtttcagacgcaggggattccacggcgtttgatactcaatgccgccaaagatggaagccgggccacgaaagatatcgctaaagctgatatcgcccgcatcgtgagactctgcgcgatgacaatatttatcgctcacccggcaaaacgggttggtaatattgcccgcattaccggcgtagccccatgccatcccgagggtgaaatcaaatggccccgcttgcttgctggccaccagatactcaccgtcaaacagacccgtaccagcaatatcacgtttaccaaacgccacttgcggtagccagtaaccttcttcccacaggcgaagtttaaaatcgaatgatttgtctttgtatgactgatcgccgctgaaatcttcccactggctatatttgcgtgtgcgcacatccgtataacgaatggtgccttccagccatgggaacagcgccacggaggtggagtagaaccggtattgatcgttatcccggtagttgacgctgaattcaccttccggtgcgatgcgcgcatttggcatctgcaacaatcctgtgccgccaaagtctgattgcgacgaacccagcggatccgggtaggttaatacttcagcatgacaggcactggagacggcaatggccaggcagcttaaaagataagaattcttcttcatcagtcaggaacacgttgcgttaaaacagacacaatctggtcatttaaatcagcatatttttcgggcagtacatgcgcagaaaagcccaaccaaagctggctgccaggcggtggttccacatgtcttttattccacagggcaacaggggcgacgacagtctcaccctcaggcgtaatcaccataacgttattcttgtccgcgcctgcaaggcgggggtgatcttgcagataatcggtaacgctacggcctgcctgccagggcaattgcccggccccagaaaccgcacccagcagagtaatagtcaccggacgctgtacggtatagagcgtatagtccccgaccaacgggggattgctgttctcatccactcgtacaaaatcaggatccagtttgaccggtaagcgaccagtgatattgagattgagtaactgctggcgcacggatttaatcgttgccgccacatcgtcgtcagcttctgcttcccaggaagcaagctgtgccatgacatgttggtagtctttaagcgctttagctttcgccgcagagtcggtcagcaaggcaccaggccaccagaggcgatcgcgcagttgcggttgtgtcaccaactggacaacattttccacggggccaacggaaagtgtctgttgttcgccaggcagataaatagtcaccgttccttgcgcaaaggcatggggtgtcattacgtaaagtacgctggcaatgaaatacgactgtaatttattcatggtgcgggtttaagaaacgtcatttctacgggaataacccctgcgcctaacatttgccgactttgacgaacctggccagtagccgaatcgacccagaatgtgttttgccactgtttttctggccgcgtggaagtcacctcttcctgccagacattacacagcacattgcgacccgcaatattcagcgtctctaatccagcaaaggaaaaagtagaactcagggtcgcagagcgaaaatggttgtcttcactccagagaatatcgcgcgtccagcggctgccatcttttattgccagcgcgttacgcagagggtcctgcccggaatttgtcacttccagcagattattattaagtttgacggtttttaaaagacgtccattgtgggtaaccagcatggcgttatcctgggataaccatttgctttgttcttgttctatatatcccagtaccacaaagattcgttgcccttcattaaggcgtaaatacatcgtggaataaggcaacgcctggatctgctgatccgctacggtgatatcctgattatcgaaaaggctggcgcgaaatgtatcgaccatactttgctggctgtgcgtacatcccgcaagaaatagtgcgaaaatcgataaaataagagggcgcacctttaatccttgaaaggttaattaaaaaaatgcaaatctctaaagcccggtacgaatatcgcaaccgggtatcatttaactttaatttcgacgcgttaaagcagtattagcgtgtagtggacgtggtggttgaggtgttatgagaaccgccatcgccactgtcatttgctgcaacaactgccaacgtcgccacaccaacagccgttgccacaccgacaactgtcgccgtgccgacagcgccagcagccacgccaccagtggtagtagcagtcgtggttgcgccggtagtggtcgttgtggtgccagtagtacccgtcgttgcctcggtcccgtttgttgcttcaggggcagcaaacgcagctggcgtcgtcaacatgaaggccataaggattgcagaaagcttgtgtttcataacttttcttttattcatcgcatggacaatacgtacgcttgagatcaggattgtctactttgagtataacatccttgtgaaatctccctttcctcataccgcttgcactatatactgcgggtaggaaaggcgcgcagagggaaatataagattgttaactatccccctctggaaatacgacttgtgagcataagataaatcttagcaaaatacaaattaaagataaggaaattgttacgaaagctattaattattgttggtaatatagtttcaagtggtactatagctggctgttaaatggcatttataactattaggtgcagagatattcgcttaaatggattagtttctttgtggaaaagtaactgatgttataatgtatgatgttgactattgcactattccaataaaaccagtcagctttaaacaagcagcgtcatattaagagagataaacatttgccgctgttggtcctcgcaggccatttacgcggcaaaattccacacgtaatcctggtataagcacttctgcgtcgcggggagtgaatgcggaaatatggacctgaacttctttacgaccgtcggaggggataatgaatcctttgccgcttttgcgatcaaaggttttgacaattcctgtcattttacgggacaaacaaattccttactgaaaatactgcgctgcactatacggggttaataaaataaagccagcgatatttaagaccgccggacggctaaaataaaatttgcttaatctcaattatcatgcgttaatagctgcgtcggtttgaaagacagacagcatacaaagtagtttactaaagcagttctcattatcaggcattatccccttcttttgagtctctctcctgaacactaagtagtttctgtattaaagccctgtttgccgaaaggcccaaaatgaaggaagtaaaatatgtctaataaaatgactggtttagtaaaatggtttaacgcagataaaggttttggctttatcactcctgatgatggcagcaaagacgttttcgtccatttcactgccatccagagtaatgaattccgcacgctgaacgaaaatcagaaagttgaattttctattgagcaggggcaacgtggccccgcggcagcgaacgttgttacgctctaaggttgccgttattactcaacatctccatttccgctgtccatgttgtcatggttcacagtaccgtacatcggcattcgatgtgacggagcgaaaccctttgggcgctaagtgtattttttgtaaatcgacgatgatcacctttgataacgtcgcgctgcaaatacgcacggaccatgcgccgctggatttcacaaaataatatcaggctccctcgtggagccttttttatatctgccttatttttcttcaacgctgtatgtatagtaagcgataacctgttgattattgaatctttcggggagatggcttataacatttcttacctgaccagggtaccgggaaccaacaccttactggcgtgttgctgtcttttaagaccagaagaggttaacagtgaatattgaagagttaaaaaaacaagccgaaacggaaatcgccgactttatcgcgcaaaaaatcgccgagctgaacaagaatacagggaaagaagtctctgaaattcgcttcaccgcacgagaaaaaatgaccgggcttgaaagttatgatgtcaaaatcaaaataatgtgattttgtgaacatcacccgtgcgaggtgatgttccgcttgttgctaatttagtgaccaatcattggcgcttgtggaattaagcgtcggtacaattcatccggtaccgggctttgccatactcccgcatacattgcgtaaccaatcaccgcaaacataatccccagaaccagtagcgtcattaaccagccagacaacgcaaaggcttttttatttgccgcaggtttttgcagtgaaaaggtcaatgttgaggctaccggacatgactctacgcaagtcatacagccggtacattccactgttcgtacctgaattaatttatcgaccgggatccgtgatgggcaattttttgcgcatttgccacagtcgatacaactttcggcattgcgacgaatcttaaacggcgacaatagcgaaaccacgcccatcagcgcgccatatgggcaaagataacgacaccaggcatggcgaataaacaggctggcaatcagcaaaacggtcacgctgattaatgtcgcggtccccatatgacgaaagaaatcgagcattttaacgtccatcaccacgctgtagggcgacaacataaaatagtgaatcgcctgagcgggcatcaataacgcgatatagagaaaaaaactcaacagcaaatacttcacgccgcgcagaggaatatccagccagcggggaaggacacattgccgaccaaacagtttgttaccgagatcgccgattaattcagaaagcgtaccaaccgggcataaccatgagcaaaaggcctttttgagtaatagactgatgacgataaaagcgaccaataacagcatcgcggcggcgtggacggacggtaactgacctgttacaaggctatatttcagattcatcagcccggcaatcggtagccagccttcgatacctcccggtctggcgacaaatgtcgtgctacttgccgtttcgtaatagcgcacccaataccagaacgtgatggcaatataaatattcattgccaacagtaataattgcgtcgctttacgccaggtcgtggcattacgccagtcattccacggtaatttgccgcccgtcgtgcctggccgccgctgccagcgggttcttttattctctgccatgattttgccagtccgttaagttgtataccaaatgccactattctagttgttcttaactggctgatattgattcaaatcgcgttcaggtctttcttatgcaaccatgcttccagagcggcaacactgcgtgtaatttcttcgtgtggaaggggggcagataatggctgctgctccagttgtgcgcatagctggctggcgatatgcattcccagactcgagcaactgctttttagctgatgcgcggcacgctttattttctcgctatcctgactggcgcgggcaatgtcgatttcatcgagaagcggcagggcatgttgtgtaaataataccagccattcgtggatcttctccgtccccattaactgagcatcttcattgagttgcgatacatccagcgattgatcattattgacttgcagttggagatagtgcgccagtaactgaccgagcacttcacgcggcaccggtttagggataatcccgcggaataatgaactggtacgctggcgcagcgtttcgtcaatgacatgggcgctaaagccaatcaaaaccagcgacggatattgctgtgccagttgtcgggcaagcgtaatgccgtcgatatccggcagatcaaaatccaccagtgcggcagcaaacggttcgctattttgcagtgtctctaaagcctgcgcggcattgccaacagcaacaatctgcgcaccactggttttcagcatctcaatggtaattcgctgggttagcgggttatcttcaattaacagcaaacgtaaaccgtcaagacgcaccgcctgattgactgtttttggcacgggtgccgtggcaacacgtaacggcaagcgtaaacaaaaacagcttccaacctccggcgtgctggtggcgctcagttcgccgcccatcgcctgggccagacggctactgatagtcagtcccagcccggtgccgccgcgtttgccgcttacctgcacaaatggctggaagatttctgccagtttcgcgggatcaataccgcagccgctgtcttccacttcgaccagccattgctcgccatcagtgcgactacgcaggataatgtacccttcgtcagtaaaacgcagggcgttgctcaacaggttggttataacctgacgaatacgtcgtggatcgcccattaacgcgcacggcatatcatcggcaattgccgttgccaggcgaatcgggcgacctttcacccgtccgctcattaattgcagggtactttccagcagcgggcgcggttcaaagggctcatcgctgaccgaaacattcttgccacctgcttcgatagcggaataatcgagaatatcgttgaggatggtcagcaacgattcaccagagtcagtaattgcccgcaaatcatcacgctgggcgttaagtgcggggttatctgccagcagttgagcagtgccgagaataccgtacagcggtgtgcggatctcatggctcatcgccgccagaaacgccgattttgcctggctggctttttctgcttccgcccgtgcctgtcggtgttctatcaccagttcctgcaattcagctgtacgcgctttgacctgcgccgccagctgttcgcggtggcgattcagtgcatgaacattgctgcgaaacgcatccatcagccgcccgatggtatccagctcccgtacgccagcggtttccgggaaaggggagtcaatatcaccgtccagcagccgttgcagcgcctgcgtttgttcggcaagtggacgcgtgactgagcgataaaccacgcgccagaggatcagaatcagtgcgcaaagtgaaaccatccccagcaataacaggctgtattgcccgcgtgcactcgctttttccagatgcgccagtccgtgctgattacgcagctcaatggtgtcgaccagctgactgacttcgctactaaactgcgcgaactgggcgatgttattttgtgcgagagtttgtaggtgattgctgatttcactgtcctgctgatacagcgccagcaaatcgctatattggctaacggtagttaacgttgttgcgacctgcgcacgaacacccggatcttcaatgcgtatttgccgacgttgcagaattttcaccgcattattgagctgcttttccagcgttggtgcatttttctggatctgctccagccccagattcatcaccatttgctgcacccgcagagcgctaaggcgcagttcattcatctggttaacatactcaagatcgatatcaatcagccgatcgagtgcactttcagcagcctgacgctgatcttgttcgatcaaatcgtaaatcccggcctgggtcgctccagcggaagttgtcgcattattcgcctgaccttgcgccaggcgtgcgatctcatcggcggcagcgactatctgctgactgagttgctgttgttgctggcgcagttgcaaacgctgccccaccagttccccttgctgacgtaacgaacgggagatctcctgctcctgttgttcaatagcggtggtatcaaaaccttgttcccgtaacgcttgcagcaacgcattaatcttcaggctttgtgcggtgagcattcgcccctgcgcctgccacatcttttcgttatcggcactggtcaggttctgcgcggcgaaaagttcccaggcgctggcttcgctcaactggcgcgccatattcatggtaggaatcaatgcctgagtgttgtctttttccacctggctgataaagcgcaggttgtaccatcccaccagggtactggtcagggttaacagcgccatcagggcaaagcccatccagagtcttcgggtcagggttaaattcacggtcggtgcactttaggtgaaaaaggttgagtcgcaaagcggaatgcatctagcataaagccttattattgatgaggctatcatgcgcgtactgctatttttacttctttcccttttcatgttgccggcattttcggctgataacctgttgcgctggcatgatgcgcagcatttcacggtgcaagcctctacgccgcttaaagccaaacgcgcatggaaactgtgcgcgctttatcccagcctgaaagattcatattggttatcgttgaactatggtatgcaggaggctgctcgccgctacggtgtggatttaaaagtgctggaggcaggcggctacagccagttggctacccagcaagcacaaatcgaccagtgtaaacagtggggcgcagaggccattttgctcggtagtagcacgacctcatttcccgacctgcaaaagcaggtagcaagtctgccggtgatcgaactggtaaatgctattgatgctccccaggtgaaaagccgcgttggtgtgccctggtttcagatgggctatcaaccggggcgatatctggtgcaatgggcgcacggtaaaccactgaatgtgctgttgatgcccggacccgataacgccgggggcagtaaggagatggtcgagggttttcgcgcagccattgccggaagcccggtgcgtattgttgatattgcgcttggtgataacgatattgaaatccagcgtaacctgttgcaggagatgctggaacgccatccagaaatcgacgtcgttgccggaacggccattgcggcagaggcggcaatgggggaagggcgtaacctgaaaacgccgcttaccgtggtgtcgttttatctttcacatcaggtgtatcgcgggctgaagcggggaagagtgattatggctgccagcgatcaaatggtctggcagggggaactggcggttgagcaggccatcaggcaattacaggggcaatcggtgtctgataatgtcagcccaccgattttagttctgacgccgaaaaatgccgaccgtgaacatattcgccgctcgctgtcaccagggggatttcgtccggtctatttttatcagcacacatcagcggctaagaaataaccttcaccatgttgcgtcaccagtaaatccgcgctgagtttatgacgtaaacgacgaattaacacatcgacggtgcgcaggtcagggttttccacccgacgcgcagaaagcatacgtagcagacgttcacggctgagaatttcgcccggattcgtcacaaatgccaccaacatttcatactctgcgcgggtcagtttaatcggctcgccatcccgctccagcgtatggcgcgacacattcaggcaataaccggcaaagcgatagcagttgtcctgagtgtgcggttgagcttgtcgcgcgaggtcgattcgccagagcagatttttcacccgtactaccagttcgcgcagttccagcggtttggtgacgtaatcgtctgcgcccatttccagcccaacaatacggtcaatccgatcgctgcgtccggtaaccagaataatccccaccgttgagcgttctcgcagggcgcgggttaacatcaggccattttcatcgggtaagttgatatccagcagaattaaatctaccgactgattctgcataatttcccgtagcccggcaccgctcgccgtaacggaaacggtatacccctcctgagtgaagtaggattgtaatcgcgcctgggtaaccggctcatcttcaacaataacaatgtgatgtggcatcagaggggtttactcattctgttcatatctgttcatattctgccgtaagccgttcatcctgaccagtgccgctgttcatatttgctcattaagatcgcttcactaaaccataattctacaggggttattatgcggaaactctggaacgcgctacgccgacccagtgctcgttggtcggtactggcgctggtcgcaattgggattgtgattggcattgcgctgattgtattgccacacgttgggatcaaagtcaccagcacaaccgaattttgtgtcagttgccacagtatgcaaccggtgtatgaagaatataaacagtcggtgcatttccagaacgcctccggcgtgcgagctgaatgccatgactgtcatatcccgccggatattccaggcatggtgaagcgcaaactggaagcgagcaatgatatctaccagacctttattgctcactccattgatacacctgaaaaattcgaagccaaacgcgcggaacttgccgagcgtgaatgggcgcgaatgaaagaaaacaactcggcaacctgccgctcctgccataactacgatgcgatggatcatgcgaagcagcatcctgaagcagcacgtcagatgaaggtggcagcgaaagataatcaatcctgcatcgactgtcataaaggtattgcccaccagttaccggatatgagtagcggcttccgtaagcagttcgatgagctgcgcgccagtgctaatgacagtggtgacacgctgtactctattgatattaagccaatttatgcggcgaaaggcgataaagaagcctctggttctctgctgcctgcttcggaagtgaaagtccttaaacgtgacggcgactggctgcaaattgaaattaccggctggacggaaagcgccggacgtcagcgtgtactcacccaattcccaggtaaacgcatctttgttgcctcgattcgtggtgatgtgcagcagcaggtaaaaacgctggagaaaaccaccgttgccgacaccaataccgagtggagcaagttgcaggccactgcgtggatgaagaaaggcgacatggtgaacgatatcaaaccgatctgggcttatgcggattcgttgtacaacggcacctgtaaccagtgccacggcgcaccggaaatcgcccactttgacgctaacggttggatcggcacgctcaacggcatgattggctttaccagtctcgataaacgtgaagaacgcaccttgttgaaatatctgcaaatgaatgcgtctgacaccgcaggtaaggctcacggcgataagaaggaagaaaaataatgaacaataacgatctctttcaggcatcacgtcggcgttttctggcacaactcggcggcttaaccgtcgccgggatgctggggccgtcattgttaacgccgcgacgtgcgactgcggcgcaagcggcgactgacgctgtcatctcgaaagagggcattcttaccgggtcgcactggggggctatccgcgcgacggtgaaggatggtcgctttgtggcggcaaaaccgttcgaactggataaatatccgtcgaaaatgattgccggattgccggatcacgtacacaacgcggcgcgtattcgttatccgatggtacgcgtggactggctgcgtaagcgccatctcagcgatacctcccagcgcggtgataaccgttttgtgcgcgtgagctgggatgaagccctcgacatgttctatgaagaactggaacgcgtgcagaaaactcacgggccgagtgccttgctgaccgccagtggttggcaatcgacggggatgttccataacgcttcggggatgctggcgaaagctattgccttgcatggtaatagcgttggtacgggcggagattactctaccggtgctgcgcaggtgatcctgccgcgcatagtcggttcgatggaagtgtatgaacagcaaacctcctggccgctggtattgcagaacagcaaaaccattgtgctgtggggctccgatttgctgaaaaaccagcaagcgaactggtggtgcccggatcacgatgtttatgaatattacgcgcagctaaaagcgaaagtcgccgccggtgaaattgaggtcatcagcatcgatccggttgtcacatccacccatgagtatctggggcgcgagcatgtgaagcacattgcggttaacccgcaaactgacgtgccgctgcaactggcgctggcacatacgctgtacagtgaaaacctgtacgacaaaaacttccttgctaactactgtgtgggttttgagcagttcctgccgtatctgctgggtgagaaagacggtcagccgaaagatgccgcatgggctgaaaaactgaccggcattgatgccgaaaccattcgtgggctggcgcggcagatggcggcgaacagaacgcaaattattgctggctggtgcgtgcagcgtatgcagcacggtgaacagtgggcgtggatgattgtggttctggcggcgatgctggggcaaattggcctgccaggtggtggttttggttttggctggcactacaacggcgcaggcacgccggggcgtaaaggcgttattctgagtggtttctccggctctacgtcgattccgcctgttcacgacaacagtgactacaaaggctacagcagcactattccgattgcccgttttatcgatgcgatcctcgaaccggggaaagtgatcaactggaacggtaaatcggtaaaactgccgccgctgaatatgtgtatttttgccggaactaacccattccatcgccatcagcagatcaaccgcattattgaaggcttgcgcaagctggaaacggttatcgccatagataaccagtggacctcaacctgccgctttgccgatatcgtactgcctgcgaccacgcagtttgagcgtaacgatctcgaccagtacggcaatcactccaaccgtggcattatcgccatgaaacaggtggtgccgccgcagttcgaggcgcgcaacgacttcgatattttccgcgagctgtgccgtcgctttaatcgcgaagaagcctttaccgaagggctggacgaaatgggctggctgaaacgcatctggcaggaaggtgtacagcaaggcaaaggacgcggcgttcatctgccagcgtttgatgacttctggaataacaaagagtacgtcgagtttgaccatccgcagatgtttgttcgccaccaggcattccgcgaagatccggatctcgaaccgctgggcacgccgagtggcctgattgagatctactcgaaaactatcgccgatatgaactacgacgattgtcaggggcatccgatgtggtttgagaaaatcgaacgctcccacggtgggcctggctcgcaaaagtatccgttgcatctgcaatctgtgcatccggatttccgacttcactcgcagttatgtgagtcggaaacgctgcgtcagcaatatacggtagcgggtaaagagccagtattcattaacccgcaggatgccagcgcgcgcggtattcgtaacggtgatgtggtacgcgtctttaacgctcgcggtcaggtgttggcaggggcagtggtttctgaccgctatgcacccggcgtggcacgaattcacgaaggggcatggtacgatccagataaaggcggcgagcctggtgcgctgtgcaaatacggtaaccccaacgtgttgaccatcgacatcggtacatcgcagctggcgcaggcgaccagtgcgcacactacgctggtggaaattgagaagtacaacggaacagtggagcaggtgacggcgtttaacggccccgtggagatggtggcgcagtgcgaatatgttcccgcgtcgcaggtgaaatcatgaccacgctgacagcacaacagattgcctgtgtttacgcctggctagcgcagttgttctcccgtgagctggacgatgaacaactgacgcaaatcgccagtgcgcagatggctgaatggttttcgttgctgaaaagcgaaccgccgctggctgcggcggtgaatgagctggaaaactgtattgccacgctgacagtacgtgacgatgcccgtctggaactggccgctgacttttgcggcctgtttctgatgaccgacaaacaagcggcgctgccgtatgcatcggcctacaaacaggacgagcaagagattaaacgcttgttagttgaggcagggatggaaaccagcggcaatttcaacgaaccggcagatcatctggcgatctatctcgaattgctcagccatctgcatttttcgctgggagaggggaccgttcctgcgcgaagaatcgacagtttgcggcaaaaaacactgacggcgctgtggcaatggttaccagagtttgttgcgcgttgtcgtcagtatgacagctttggtttttacgcggcactaagccagttattgctggtgttagtggagtgcgaccaccaaaacagataacgtcgtttgtgcgcctgaaaagacgcgtttagcgtcgcatcaggcattatggcgcagttgccggatgcggcgtgaacgtcttatccggcccacaggaactgtaatctttgtagaccggttaagatgcgtcatcgcatccggcaaacacacatcacggatgagctacaaaccgggaaagccgctggcgcagcaggcggttttcctgcttcaggtgcgcaatatcatccattaacgtcagcgccaccgcgatccccggccagtccagagccagttcatgacgcaggcgtaccgcgcgttgcaccacaatggcggcatggtcgtcaaatacccaggttgtttcctggatctcacgcggttcaaccacccccaaaccgacaatttcattcaactcctcttcagagatgccggtatgcaggcaaaattcggtaatagtaaaagtcaccgtaacattagccattatgctttcccccaatctttacgtggatcaaaagacgactgggcgtctgccagttgctgccacagcgcggcagtgttttcatccggtttcggcggcatcacgattttcagtaccgcatacagatcgccggtctgttttttgctcaccagacctttgcctttaacgcgcaatcgttgcccggcctggctgcctggcgggatagtcagcaaaatgctttctttcagtgttggaacggtgactttagcacccagcgccgcttcccacgggctaaccggcaccacaatttccagatcctggccgacaatatcaaacagcggatgtggcgcaatatgaatcaccagccacaaatcgccatttggaccgccgttttcgcccggcgtcccctggcctttcagacggatgcgttgaccattgccgacgcccgccgggatcttcacattcagcgttttcggaatttcctgttcgatcatgccaaaggcgttataaaccggcaggttatagctgatggtacgcttatgctcagtaagcgtttcttcgaggaataccgccacttcgatttcaatatcgtggccgcgtgtggcggggcgttgacggctctggcgggcatgctgaccgaaaattgacgagaagatatcgtcaaaatcttcggcgttaaaactctgaccgtcgccatggtggaactgacggttaaattgcggatcgttgcgatgttgccacatctgatcatactcagcgcgacgttgttcatcacttaacacttcccaggcttcagcgacctctttgaagcgggcttcggcatccggttctttgctgacatcaggatggtatttgcgggcaagtcgacgataggcggtcttgattgtcttgagatcgtccgtcggtttcacgcccatgatggcgtaataatcctttaattccatagcgttatctcgcgtaaatcaacacaaattgaaggaacccctgtaaggtaactcctataagtgtagggtaatcctcaaaatttcatatgccaacacagaatatgttattgaaatcatcgcggagaggaggtcgccatcaagatgggttgctgaacatattttaaacaggtgaaaaagggtgagcgatttttgatagttgaaccaggcactttaagtttaactagggcgtcattatttattaaattttatagacgctatatatgggtagtaatatacatggaattagttgcactgcaaataattatttgaaacaggcctggaacgatataaaaaatgagtacgaaaaaaatcaaacatattcaatcacgctttttgaaaacacactggtgtgttttatgcggttatacaatgaactcagacgtaaagtaaatgaagaggatactccatgtctggaatgtgaatcactagaaaaagaatttgaggaaatgcagaatgataatgatctatcattatttatgagaacattgcgtactaatgatacacaaatttattcaggggtttcaggaggtattacatatactatacaatatgttcgagatattgatattgttagagtgtccttgccgggcagagcttcagagtctatcacagattttaaaggttattattggtatggctttatggaatatattgaaaacattaatgcgtgtgatgatgttttttctgagtattgttttgatgatgaaaatataagtgtccagccagagcggataaatacgtcgggaatatctgatttggattctgacattgatttgtctggtatatcttttattcagcgtgaaactaaccaggcattaggattaaaatatgctcctgtagatggcgatggatattgtctgttaagagctatactggttttaaaacaacatgattattcatgggcgctggtcagttataagatgcaaaaggaagtttacaacgaattcattaaaatggttgataaaaaaacgatcgaggctcttgttgatacggcattctataatctcagggaagatgtaaagacgttatttggcgttgatctacaatctgacaaccaaattcaggggcagagtagtcttatgtcatggagctttctgttttttaaaaaacaattcattgatagttgcttgaataacgaaaaatgtatcctgcatttacccgagtttatatttaatgataacaagaacttgcttgctttagataccgacacgtcggataggattaaagcggtgaagaattttcttgctgttctttcagatagcatttgctcattatttattgttaatagtaatgtggcatcaatctccttggggaatgaatccttttcaacagatgaagatcttgagtatggttatttaatgaacactggcaatcattatgacgtttacctccctcctgaactttttgctcaggcttacaagttaaacaataaggaaatgaatgcgcaacttgactatttaaatcgttatgcaatttaatggcaaaggcatatgctaaaaaccattgttattagtctcacacttttttattggtaaatattgtctctgtattggtaacgccgcagatattctgtttagccacaggtgcaattatcagcggcgtacgcgaggcaggggctaatcaggcatagtttgcgtcaaaccttgcctgtttttgaagatgtatatagaaaaacaggcgttcaacaagccattttgcgaacctgttcccggaaaaatgtcatatttctgtcacactctttagtgattgataacaaaagaggtgccaggaatgaacaaaacgctaatcgccgcagctgtggcagggatagttttactcgcttcaaacgctcaggcacaaaccgtaccggaaggctatcagctacagcaagtgctcatgatgagccgccataacttacgtgcgccgctggcgaacaatggcagtgtgctggagcagtcgacgccgaataaatggccagaatgggacgtccccggtgggcaactcaccaccaaaggtggcgtgctcgaagtgtatatgggccattacatgcgtgaatggctggcagagcaggggatggtgaaatcgggggaatgcccgccgccgtacaccgtttatgcctatgccaatagtctgcaacgtaccgttgcgaccgcacagttctttattaccggcgcattcccggggtgtgatattcctgtgcatcaccaggaaaaaatgggcactatggacccaacctttaacccggtgatcaccgatgattccgccgcattcagtgaacaggcggtggcggcaatggagaaagagctcagcaaactccagcttaccgacagctaccagctactggaaaaaatcgttaactataaagattcccctgcctgtaaagagaaacaacagtgttcgctggtggatggcaaaaatacctttagcgcgaagtatcaacaagaaccaggtgtttccgggccgctgaaagtcggcaactcgctggtagatgcgtttactttgcaatactacgaaggttttccgatggatcaggtggcctggggagaaatcaaatctgaccagcagtggaaggtgttgtcgaagcttaaaaacggctaccaggacagcctgtttacctcaccggaagtggcgcgcaatgttgcgaaaccgctggtcagttatatcgacaaagctctggtcaccgatcgcaccagcgcaccgaaaattacagtgttggttgggcacgactccaacattgcctctctgttaacggcgctggatttcaaaccgtatcagttgcatgaccagaacgaacgcacgccgattggcggcaaaatcgttttccagcgttggcatgacagcaaagccaatcgcgatttgatgaaaattgaatatgtgtatcagagtgcggaacagttacgtaatgccgatgcgttaaccctgcaggcacctgctcagcgtgtgacgctggaattaagcggttgcccgatagatgccaacggtttctgcccgatggataaatttgatagcgtgttgaatgaagcggtgaaataacagaaaactcccccgcgagaagcgggggagtatgagattgatgacaaacgtgagattgcctgatgcgctacgcttatcaggcctacccgagaattgcactatatcgaatttgcacgatcatgtaggccggataaggcgttcacgccgcatccggcatgaacaaagcgcactttgtcaacaatttgaaagcccccccgcgtgaagcgggggagccgctggttaaacgtttttacgttcgatggtctgttcgccccaaaaaagcgaatctttatcggtcttagcaaaggctttgactaacacttcatcgctaccttcttcccaaatcttttccgccattttttcgtcgtacccggcgacttcgaaaatggcctcggctatttccggcgacgtattgcgcagagatgcccattcaccgacgtgatgagctttcgcttcttgagttggcatgcgtatcctcctgttgaagattagccgttaagtttaactgccagacctgcgacatattccccttgataacgagcaatagacagttcttcctggcttggctggcgtgagccgtcaccgcctgcgatggttgttgcgccgtacggcgtaccgccgcgaacctgtgaaacgtcaaataattcctgcgctgcgtagccaatggggacaattaccatgccgtgatgcgcaagggtcgtccaggttgaagtaatagtttgttcctgaccgccgccagtaccggtggaactaaagacgctcgccagttttccgtatagtgcgccggaagcccacaggccgcccgtctggtcgaggaaggtacgcatttgaccggacatgttgccaaagcgggtaggtgtaccaaaaataatggcgtcgtaatcggccagttcttgcggggttgcaaccggtgcagtttgcgttttaccgcctgctttttcaaataattgcggcggcatggtttccggtacacgcttaacgacaacttctgcgccatccactttgcttgcaccctcagcgactgcgcgtgccatcgtttcaatatgtccgtacatggaataataaagcaccagaactttagccatttctaaccactcctcgtgttatctctattccgtagcgattcgctaccacttatttaaagataagacgtccttttcagagtgcaaatttcacaaccacttatttgatttataacaactttcacaagcacgtaattttgtcgcaaaatgacacatttttatctcatcgcgtttttttaatcataagagcggcttatggataattattggagatgatatctattctcgctaagaagctgttgcaggatattaccaaacgcgggtctgcccgcgtcagttcactaagcttagtcccacgtagcgaaaatatggcagccgccatacgccgcgttaattctatgcaatatgatgtctatacccagacggaggtcagtaatggcaaaccatcgaggcggttccggcaattttgcagaagaccgcgaaagagcatcagaagcaggtaaaaaaggtggacagcacagcgggggtaatttcaagaatgacccgcagcgcgcatctgaagcaggtaaaaaaggtggcaagagcagtcacggcaaaagcgacaactagccgggctaatcaatgacgaatgcatttttgtctgtagctcgtcaaaaagccatcaccgccggttacccggtggttgatactgatgacaaatgtaagcttgcctgatgcgcgatgcttatcaggccttgtattatccctccagtgcagagaaaatcggccagttttctctgcctgcagtccgcatgccgtatcgggccttgggttctaacctgttgcgtagatttatgcagcggactgcctttctcccaaagtgataaaccggacagtatcatggaccggttttcccggtaatccgtatttgcaaggttggtttcactatggaacatgaacttcattatatcggtatcgacaccgctaaagagaaactggatgtcgatgtgttgcgtcctgatggtcgtcatcgcaccaaaaaattcgctaacaccactaaagggcacgatgagctggtgagctggctgaaaggtcacaagattgaccatgcgcatatctgcatcgaagcgaccggcacctatatggaacctgtcgctgagtgcctttacgatgctggctacatagtgtcagtcattaatcctgcgctgggtaaagctttcgctcagagtgaaggactgcgtaacaagactgataccgtggatgcgcgcatgctggcagagttctgtcgtcagaagcgccctgcagcctgggaagcgcctcacccgcttgaacgcgcgttgcgtgccctggtagtccgccaccaggcgctgacagatatgcacacgcaggaactgaatcgcactgaaacggcgcgggaagtccagagaccgagcattgatgctcaccttctgtggcttgaagcagagctgaagcgtcttgagaagcagataaaagacctgacagacgatgatccggatatgaaacaccgcaggaaactgctggaaagcatcccgggtatcggagagaaaacatctgcggtattgctggcttatatcggtctgaaggaccgcttcgcccatgccagacagttcgccgcttttgcgggtctgacaccacggcgttatgaatcaggtagcagtgtgagaggggcgagccggatgagtaaggccggacatgtgtcgcttcgcagggcgttgtatatgcccgcaatggtagccaccagtaagactgagtggggacgggcgttccgcgaccgtctggcggctaatggcaagaaaggaaaggtgattctcggcgcgatgatgcgcaagctggcacaggtggcgtatggagtgctgaagtcaggcgtgccgttcgatgcgtcacggcataatccggtagcggcgtaaaaatcgcggaagggatgaaaaaaacagcgcctgacggcgctgtgtctggcatgcctgcaatccgggaaaccggaccaggaaaaaacttgcaggccataacagtatctaccagaagattgcaatatattgaatttgcactgttttgtaggccggataaggcgtttacgccgcatccggcatgaacaatgcgtacgttgtcaacaatctgcaccgccgggtaatcccggcggttttctgtttatggctcctgatgaacaacttctggcggtggaacgtcaaccaactttctgcttaacaacgcattgagtaaaatcgcgccaaaggttgctgtaccaatccctcccaacgtaaaaccgcccagcgtgagagcaaaatcacccgcgcccagcactaaggttactgcgaccataatcaaattaccgttctggcttaaatcgacacggttttgtacccagatccttgcgcctgcgacggcaatcagcccgaacacaacaattgatgcaccaccaatcaccgcggccggaatggtatgaatcagcgcgccaaatttcggtgaaaagcccaacagcatggcgatggcggcagcagcgacaaacaccagcgtcgagtagacttttgtcacggccattacaccgatattctcggcgtaggtggttacgccgctgccaccgacagaaccagaaagcatcgtcgccagcccatcaccgacgaatgcccgtcccatatatggatccatattgcgtccggtcatcccggcgaccgccttgagatggcctaagttttccgccaccagaatcaccgccacgggcgcaatcagcatcattgcctgaccattaaaagcaggagtggaaaaatgtggcaaaccgaaccaggcagcatggctgacgagagtaaaatcgacggcttttcccagccctaaaacgttggtcatcacgccatacagcagacaggcgacaattaatcctacgagaatcaataatcgctggatcatgccacgggtaaacaccgccaccagcccaatacacagcaccgtcattaccgccatccagctatcaaaggccgaagccgatacacttttcactgcgataggcgctaagttcaggccaatcgccatcaccaccgcacccgtcaccaccggcggcattagccgttcaatccagcgtgtaccgattttcatcaccaccaggccaatgacggtataaaccagcccacaggcgataatcccgcccagcgcaatgctgatattcgggttaatgccctgaccgttaaagcccgtcgcggcaatcaccacgccgacaaaagccgcgctggaaccgagataactggggacgcgcccgccggtaataaagaaaaacagtaatgtgccgatccccgacattaaaatggaaagattgggatccagccccatcagaatcggcattaacaccgtcgcgccaaacatcgccaccgcgtgttgaacgcccattattgccgtctgagcaaacggcaatcgttcatccggcgcgaccacgccgctctctgtagaggtcgattttaactgccagtgaggaagaccgaacattgccatcagctgtctccttaaggaggttaacaagcagggcgcatcagcgcgtgataactgcgatcgaaccacaccagcccgtagggtgtggcgtgacgatgaatcgcttcgatggcgcaaaacaaaatgtcgtgggtgccgacgctcaccacctggctgatacggcagtcaaacgaaaccagcgcctcttccagttgcgggcatccggtcacaccagtctgccagcgggcggcggcaaagcggtgttccatgggcgttttgccgccaaaaaggtttgaaagcggctcctgcccggcgctaagtgtatttacacacagcgttcgattttcattgaataccggccagacggacgccccacgattcaggcacaccagtaatgtgggcggcgtgtcggtcacgctgcagacggcgctggcggtgaacccggcgcgcccggctggaccgtccgtggtgatgatattgaccgccgcgcccatgcaggacatcgcatcgcgaaaagtttgttgatcgacaatgttcatagtttgctccttacaacagcccgcaggcttcttcaaaggacagacgtggcaggcgcgcaaaaagtttgctgctatcgccatagccgatattaatcagcagattgctcttcagcgtgctgcccgcaaaaaaggcgtcgtcaacgtgttgacggtcaaaacccgacatcgggccggtatccagtcccagcgcacggcaagcgatgataagataggccgcctgcatggaactgttgcgaaacgctgtttcttcggcaagttgtgggctggaggtaaaccaactgcgggcatcgccgtgaggaaacagttgcggtaaccgttcataaaattcactgtcccatgcgacgatagcggtgacgggcgcggtcagggttttttgcagattgccgctggaaagcgccgggcgcagacgttcttttccctctgcagtgcggataaacacgatacgtgccggagaacagttagctgatgtcggcccccatttcatcagggcataaagctcccgtaacgtctcatcgctgacgggtgtctcccgccagccattgtgagtgcgggcatcggtgaacagggtgctaagcgcacctgggctaacggcttcgttcatagcaattccttacagggcggcttcacggtgatgtaacaggctggcaagcccgttgagtaacagagcattaaacgtttcgggatcggtcacgttgcaggcgtgtccgccatagcgcatcaccattttctggctatcgggcagggcggcatgaagttcactggaacatgctgatggcaccagcagatcatcactggcgcagatgatttgcaccgggcagcggatgcgatccgcatggtgactaaagtcagcgcgtttgagggcgttaagtcgacgcagtaaattatttttgccctgaaaatgcgccagtgccagcgcgtcttctgcctcaaggcgaggtgcgcgggccgccatccagtcggcgggatagaggaacaacggctgcgcttccacccatgcctgcgcgccaccgctatacagtaatcgttcgcgaacctgaaaacagcggcgcgtatgggcgtttattcgtagccagccgttaacgctgaccagcacagttaccgacgcgggataatccagcgccagctgcattcccaccagcgcaccgagcgcatggccgaccaccgcgtaatgctcaatccctgcggctaccagcacctgatgcagttccgctgccatctgggcgatactgtaatcttctgccagtgtgtcgggattattgccggtgccgcgctggtcgtaacagactacctgatactcctgctccagcaccgccagttgcggtaaccagtaactgccgctaccgccaagacccgaaatcaacaccactacgggtgcatcagcataagggggaggtgagagtgaaagtttcatcgcggcctcacttggcgatatgcgcaattgtggcgatttccaccagcgcgtcaggttttaccagtccgcactgaatgcagaatcgcgccggtttatcacccggaaaaaactcggcgtagatttcgttaatcgcggcgtaatttttccagtcggtaataaagatgctgttgaaggtcacatccgccatcgtgccacccgccgtctcgatcaccttgcggatggtttccagaacgtggcgggtttgcgcctttgggtcatcggcaaacagcacgttattatgttgatcaaaagccagcgtaccggagacatacaccactccatcagccagcgtgccgggaacgaagggggccagcggtgcgctgctgccagcgggaataattacggattttggcatcgttaaactccttaagcgatacgagcaaaggacgtgggagaaagcgcgtcgcagaacgtttcgacgtcgctgacccagccaaaaaaggtttcgatattgaacaacgcagctttctgcgcaaattccggccccgcctggtgagttgcgtcttccagcaccacgccgaaatactccagaaaaaagccgtcgcgtagcgtcgattcgacgcagacgttggtagcgatgccggtgaaaaccagatggcgtattccgcggctgcgcaaaatgctgtccagcggcgtattgaagaaaccgctgtagcgcggcttcggcagcacaatatcgccaggctgcggcaccagttcatccaccagttgataatcccaggagcctttcgccagcaatttcccctgcagctgcggctgtttacgcatggttttcagggcgttcgatttatgaaaattcggtgagccagggccgccagcctcgacatactgttcatcccagccattttgaaaccagatgatcaacatccctgccgctcgcgctgcagtcacggcggtttgaatgttggcaatgaccgggcgagtggttgagacatcaaacccggcgagatctaagtagccgcctggcgtggcataggcgttttgcatatccaccacgatcagcgcactttgctgcggatcgaaggtaatggcttccggtcgagcggttaatgtcgtcatcatgccacctcctgagtcagcacagggagatgggcgcggcactgcatcagtggttgaatgcgctcgccgaaggtttcgattcccgacagaaaatcgtcgaaggttaacagcacgccttcggcaccaggcacgcttgcgacttcatctaacatgcgcgcgacactggcgtaagaaccgactaacgtccccatattgatgtttaccgccgaagtgggatcggccatctgacggacgttggtgtcagtacctgagcgggtatctttctgactttgttcggttagccagcttaacgcctcttcatccgcgcccgctttgtagtgttcccatttggcgcgagcggcatcgtcggtttcatcggcaatcaccataaacaatacataagagccaacgtcgcgcccggtttgctctgcggcctgtttcatccgcgcagcggtcggggcgaaagccgtgggtgtatttacgcctttgccgaaacagaagttgaaatcggcatactgggcggagaacgccatgccagcgtcgctttgcccggcgcagatcactttcatagggacactcggttgcggactgacgcgacaatcattcatggtgaaaaaatcgcctttaaaatcgctttttcccgtgccccacaggtcgcgcagcacctgaacatactcggtgagatagtcgtaacgacgggagaaatagtcatcgccaggccagatacccatctgctcatactcgggcttttgccagccagtcacgaggttgacgccaaaacgcccgccagagattgagtcgatggttgcggccatacgggcgacgattgctggaggtaacgttaaggtggcggcggtggcgtaaatctgaatgcgcgaggtcacggccgccagccccgccatcaaggtgaacgactcaaggttgtgatcccagaactcagttttgccgccaaagccacgcagtttgatcatcgacagggcgaaatcgaaatggtagtgctccgctttttgcacgatggctttattcagttcaaaggtcggcatgtactgcggcgcgtgggtcgaaatgagccagccgttgttgccaataggtacgaatacgccaattttcatcatcaacctctcttcgtctcgtaaagtgaaagtcagacggggcactgcgtcctgcatatccttttcagccgcgtaatggcttgtttgcaaagtggatgccagtttttaaaaaagtgaatgttattaatgtgttaatgttaagttatctaaaatatctggtaaaaagcggactaaacggtcaaaacagttgcacataaaacatgcatccgtgcgcgatgagagtgcagaaggtcgaggccgggcgggggttttgctatcctgttgccaatctacaagaggggagagcgcatgacgcaaggcgcagtgaaaacaacgggtaaacgttcgcgcgtagtaagcgcgaagaaaaaagcgattcttagcgcagcactggacactttttcacaattcggttttcacggcacaaggctggagcagatcgcagagttggcgggtgtttcaaaaaccaatctgctgtattactttccgtcaaaagaggcgctgtatattgccgtgctgcggcagattctcgatatctggctggcaccgttaaaagcgtttcgagaagatttcgccccgctggcggcgatcaaagagtacatccgtctgaagctggaagtctcacgcgattatccgcaggcttcgcgcctgttctgtatggagatgctggcaggcgcgccgctgttaatggatgaactgacgggcgatttgaaggcattaattgatgagaaatcggcgctgattgccggttgggtcaaaagcggcaaactcgcgccgattgatccgcagcatttgatttttatgatttgggcttccactcaacattacgccgatttcgcccctcaggtggaggcggtgacaggcgcgacgttgcgcgatgaggtatttttcaatcaaacggttgaaaacgtgcagcggattattattgaggggattcgaccacgttaaagatgccggaggaggttgtaacatcctccggctacctgtttaacctatagtcattaagctggcgttaccgccagcggcagcggtattcacactcagcgaacgctcgatatacagccgttccagaaggatattgctttcgccacgggcaaaaccctgcaccgaaacaattgcgccatcccgcgcagcaacggcttcacacaatgcgcgaagctgatccgaatcaccgtggaagatcaccgcatcaaacggttgagcggttatattttccgctttcgccagttgaatacgttcgctgactgccgatggcaatgccttcactaactgacgatgcagcgcgtcatccggccacagtacctggctgcccaccgccagcacggcggcgagctgagtcagcgcatcctgctcatcatcggcaatacacaacacgcgctcacgcggcagcagcgtccaggtgttgcgttcacccgtcggccccggcagcaatcgttgtgttcctgcctgcgccagctcgccatattgcgtacataacgcctgcaattctggacgatttgctgcccattcccgcagtgcatttagcggctgagtcaatgcggctttcaactgcgcatcgaccggatactctgcatcctgacgcgcgagcgttactgccagcgcactttccgggcgattcgccagcagacggtagagatagagcggaccgcctgctttcggcccggtaccggacaacccttcgccgccgaacggctgcacaccaaccactgcgcccaccatattacggttaacatacaggttaccaacatgggccgagccagtgacctgggcgatagtttcatcaatacgcgtatggacgccaagcgtcagaccataaccggaagcgttaatctgctcgatcagctctggtagctggttacggttgtaacgcaccacatgcagcaccggaccaaagacctctttttgcaattcggcaaagtcatccagttcgatcagcgtcggggcgacaaaggtgccgctttgccattcacgggcatcttcactgttttcccgcaccgcctggaacaccggacggcctttgctacgcatggtctgaatatggcgctcaatattgactttcgcttcgctatcaatcaccggaccgatatcggtggtcaggcgacccggattacccatccggcattcggccattgcgccgcgcagcattttcaacgtgtggtcggcaatctcatcttgcaggcacagcacgcgcagcgccgaacaacgctgacccgcactgtcgaacgccgaggccagcacatctattactacttgttcggtcagtgctgaagaatcgacaatcatcgcgttcatgccgccggtttcagcgatgagcggaatagggcgaccctgagcgtccaggcggctggcgatattgcgctgcagtaacgtagcgacttcggttgaaccggtaaacatcaccccgcgtacgcgatcatcacccgtcagttgcgcgcccacggtttccccctgacctggcagcaactgcaccacgcctggcggtacacccgcttccagcaaaatggcgatcccttgcgcggcaatcagcggcgtttgttctgccggttttgccagcacgctgttacctgccgccagtgcggcagcaatctgcccggtgaaaatagccagcgggaagttccacggactgatacacaccacaggccctaatggacggtgggtttcgttagcgaaatcatcccgcacctgtccggcatagtagtggagaaaatcgaccgcttcgcgcacttcggcaatggcgttactgaaggtttttccggcttcacgcaccagaataccaatcagttgctgcatctggctttccattagcacggcagcgcgatgcaaaatcgccgcgcgttcaaccggaggagtggcaaaccagattggcgcgttattaaccgcactttccagcgcctgttctacctcacgcggcgtggcttcacgcacaaagcccacaatatctttcggttccgcagggttaataacgggcgacatctcacctgccgctaccggttgttccagcattggcaaggcctgccatttttgcagtgcactattgagcagggcagaagagagcgaggccagacggtgttcgttagcgagatccagccctgccgagttgtcgcgcccgtgaccgtaaagatcgcgcggcaggggaattttcggatgcggtaatccagtttgcccttcctgttgcgccagtttttctacagcagtgaccggatcggcgaccagttcatccagtggcaaagaggtgtcggcaatacggttaacaaacgaggtgttagcaccgttttccagcaggcggcgcaccagatacgccagcagcgtttcatgtgtgccaaccggggcataaatacgacacggacggttaagtttgccgtcggcaactttcccggtgacctgctcatacagtggctcgcccataccatgcaggcactggaactcgtactgacccggatagtagttttgaccagccagttgataaatcgctgccagcgtatgggcgttgtgcgttgcgaactgcgggtagattagattcggcaccgccagcagctttttcgcacaggcgagatatgaaacgtcggtatacaccttgcgggtataaaccggatagccttcaaggccgtccatctgcgcacgcttgatttcactatcccagtacgcgcctttcaccaggcgaatcatcagacggcgacggctgcgggtggcgagatcaatcaggtaatcaatcaccagtgggcagcgtttttgataagcctgaataacaaaaccgataccgttccagcctgccagctcaggctcgaaacagagtttttccagcagatcgagggagatctccagacgatcggcctcttcggcgtcaatgttgataccaatatcgtactgacgcgccagcagggtgagtgatttcagacgtgggtaaagctcttccattacccggtcatactgggcgcggctgtaacgcggatgcagcgccgacagcttgattgaaatgcccggaccttcatagatgccacgaccattggacgctttaccaatggcgtgaatcgcctgctgataggaaaccatatacgcttgtgcatctgcggcagtcagtgcagcttcgccaagcatatcgtaagagtaacggaaacctttctcttccagcttgcgggcattggctaacgcttccgcgatggtttcgccagtgacgaactgctcgcccatcaggcgcatcgccatatccacacctttgcggatcagcggttcaccgcttttaccgataatgcggttcagcgagcgggagaggctggcttcgttatgggtggaaaccagtttgccagtaaacagcagcccccaggtggcggcattaacaaacaaagacgggctacgaccaatgtgtgattgccagttaccgttgctgattttgtcgcgaattaacgcatcacgggtggctttgtcgggaatacgcaacaacgcttccgccagacacatcagcgccacgccttcctgcgatgacaacgaaaactcctgcaataacccctgaaccatacctgcgcgaccactggcgtttttttgattacgcagtttatcggccagttgatacgccagtttgtgcgcctgttcagcaactggctgcggcaggcgggcttgttccagcagcatagaaaccgcttcggtttccgggcggcgataggccgctgtgatcgcggcgcgggaaaccgactggggcaaaatttgctcggcaaagtcgaggaatggttggtgtggttcctctgccggagtcggtgcttcatcgctctcattggcagcgccagaaagcagcgcaggtagctccggcagagtatcgctgttttccagttgttcgagataagaaaaaatcgcctgcttaattaaccagtgtggcgtgcgatcgatacgtgtcgcggcagacttaatacgctcacgcgtcgcgtcgtccagcttaacccccatggtggtggttcccatgccattactcctgttgttctgaaaggtgcaacttaacgttatcgtgaaatatccatgatgttgcaactttgtgcaaccatgttaaatgtgacatgcgtagcaagcttaaaaatgaatgaaatgttaataaaagaaatcgatatgacagggattaaaaaaataactcagactttttctctgcggcagttaacatttttgaaaggtgcaaccgcaaaaaatgtgagagagtgcaacctgatgaaaaatagtgtcgctgagcactaaaatttaatgtaaatggtgtgttaaatcgattgtgaataaccagcgcttccggcaggatacggtcgccctggtaaaacataaactctgttaccccgttccggtggcagatataacggcaagtttcgacattgccgataataattttttggagactttagatggctattagcacaccgatgttggtgacattttgtgtctatatctttggcatgatattgattgggtttatcgcctggcgatcaacgaaaaactttgacgactatattctgggcggtcgtagccttgggccattcgtgacggcattatcggcgggtgcgtcggatatgagcggctggctgttaatggggttgccgggcgcggtttttctttccgggatttccgaaagttggatcgccattggcctgacattaggcgcgtggatcaactggaagctggtggcggggcggttgcgtgtgcataccgaatacaacaataacgccttaacattgccggattatttcaccgggcgctttgaagataaaagccgcattttgcgcattatctccgcgctggtgattttgctgttcttcaccatttattgcgcttcgggcattgtggcaggcgcgcgtctgtttgaaagtacctttggcatgagctacgaaacggctctgtgggcgggagctgcggcgacgatcctttacacctttattggcggtttcctcgcggtgagctggactgacactgtacaggccagcctgatgatttttgccctgatcctgacgccggttatcgtcattatcagtgtcggtggctttggtgactcgctggaagtgatcaaacaaaagagcatcgaaaacgttgatatgctcaaagggctgaactttgtcgccattatctcactgatgggttgggggctgggttacttcgggcaaccgcacatcctggcgcgttttatggcggcagactctcaccacagcattgtccatgcgcgtcgtatcagtatgacctggatgatcctctgcctggcaggggcggtagctgtcggcttctttggtattgcttactttaatgagcacccggcggtagcaggtgcggtaaaccagaatgctgagcgcgtgtttatcgaactggcgcaaattctgtttaacccgtggattgccgggattctgctgtcggcaattctggcggcggtaatgtcaaccttaagttgccagctgctggtgtgctccagtgcgattaccgaagatttatacaaagcgtttctgcgtaaacatgccagccagaaagagctggtgtgggtaggtcgtgtgatggtgctggtggtggcgctggtggccattgcgctggcggcaaacccggaaaaccgtgtgctggggctagtgagctatgcgtgggcaggctttggcgcggcgtttggtccggtggtgctgttctcggtgatgtggtcacgcatgacgcgcaacggtgcgctggcggggatgatcatcggggcgctgacggttatcgtctggaaacagttcggctggctgggactgtacgaaattattccgggctttatcttcagcagtattgggattgtagtgtttagtttgctgggtaaagcgccgtcagcggcgatgcaaaaacgctttgccgaggccgatgcgcactatcattcggctccgccgtcacggttgcaggaaagctaaggaacttagcctgcggcggttttgtttggcttcagcagcgggttgcgctcccttaatgtgcctcgccatataaattgaatggtgcagggagcgcgcagggggcggccaatcgccgccgccccctgctgtcccggccttcggggaacgcttcagcgattttgacgccaccaacacccgagctgttattatgttccgggcaaaaagttagatttgataatcgcggatggacgaaattgcttgatacacccgcttatcagttttacatggaagctctgatgcattgagtctggacagttttgtcggctggatacggcgtttacgcggcatccggcaagaacacatggctcgttgtaaacaatcccatctttgtacctggaataatcgtttatatcccctggcattacctctctttgtttacatttcaacatcattttataaacattccgcttgtatttttctttaccgtaatgataatcgctatcactgcgatttacttttctttgcatagattgactcagaaaaacgtttaagggtgggtggcatgtttgttccgtttctcattatgttgcgcgaaggacttgaagccgcgctgattgtcagtttgattgccagctatcttaagcgtacccagcgaggccgatggattggtgtgatgtggattggcgtgttgcttgccgctgcgttgtgcctgggcttgggtatcttcattaacgaaaccaccggcgaatttccgcaaaaagaacaggaactgtttgaaggtatcgtggcggtgatcgccgtggtgatccttacctggatggttttctggatgcgcaaagtgtcgcgcaacgtcaaagtgcaactggaacaggcagtcgatagcgcattgcagcgtggaaatcatcatggctgggcgctggtgatgatggtcttttttgccgttgcaagggaagggctggagtcggtctttttcctgctggcggcatttcaacaagatgtcgggatctggccgccgctgggtgcaatgctcggtcttgctactgccgtggtgctaggcttcctgctctactggggcggtattcgcctcaatcttggtgcattttttaaatggaccagcctgtttattctcttcgtcgccgcagggctggcagctggtgccattcgcgcatttcatgaagccggattgtggaaccactttcaggaaatcgccttcgatatgagtgcggtgctctcaactcactcgctgtttggcacgctgatggaagggatttttggctatcaggaagcgccgagcgtcagcgaagtcgccgtctggtttatttatctcatcccggcgctggtggcatttgctctgccaccacgcgcaggggcgacagcgtctcgctccgcgtaacaaatacgacgcaaactcttgcttagttacaacatactttaaagggatagtctcgtcatgaccattaacttccgccgtaacgcattgcagttgagcgtggctgcgctgttttcttctgcttttatggctaacgccgctgatgtgccgcaggtcaaagtgaccgtgacggataagcagtgcgaaccgatgaccattacggttaacgccgggaaaacacagttcattattcagaaccacagccagaaggcgctggagtgggagatcctcaaaggcgtgatggtggtggaagagcgggaaaatatcgcccctggctttagccagaaaatgacggcgaatttacagcctggcgaatacgatatgacctgcggtctgctgactaacccgaaagggaagttgatcgtcaaaggtgaggcaacggcggatgcggcgcaaagtgatgcgctgttaagtcttggtggtgcaattactgcatataaagcgtatgtcatggcggaaaccacgcagctggtgaccgacaccaaagcctttaccgacgcgattaaagcaggcgatatcgaaaaagcgaaagcactgtatgcaccgacgcgccagcactatgagcgtattgaaccgattgctgaactgttctccgatctggatggcagcattgacgcccgtgaagatgattacgagcaaaaagccgccgacccaaaattcactggtttccaccgtctggaaaaagcattgtttggcgacaacaccaccaaagggatggatcagtacgctgagcagctttataccgatgtggtcgatttgcaaaaacgcatcagtgaactggctttcccaccttcaaaagtggtcggcggcgcagccggactgattgaggaagtggcagccagcaaaattagcggtgaagaagatcgctacagccacaccgatctgtgggatttccaggctaacgttgaaggctcgcagaaaattgtcgatttgctgcgtccacaactgcaaaaagccaacccggaactgctggcaaaagtcgatgccaactttaaaaaggtcgataccattctggcgaaataccgtactaaagacggttttgaaacctacgacaaattgaccgatgccgaccggaatgcactgaaaggaccgattactgcgctggcggaagatctggcgcaacttcgcggtgtgctgggactggattaagcgttatgcagtataaagatgaaaacggcgtgaatgaaccgtcacgccgacgtttactgaaagtgataggtgcactggcgctggcgggaagttgtccggtcgctcatgcacaaaaaacgcaaagtgcgccgggtacgctttcaccggatgctcgcaatgagaaacagccgttttatggtgagcatcaggcagggatcctgacgccacaacaggccgcaatgatgctggtggcgtttgatgtgcttgccagcgataaagccgatcttgagcggttgtttcgcttgttgactcagcgttttgcttttctgactcagggcggagcagcaccagaaacgccaaatccgcgcctgccaccactcgattccggcattcttggcggctacattgcgcccgataatctcaccatcacgttatcggtgggtcactcattgtttgatgagcgctttggccttgcgccacagatgccaaaaaagctgcagaagatgacgcgtttccccaacgactcgctggatgcggcgttatgtcatggtgatgtgttgctacagatttgcgccaacacccaggacacggttatccatgcgctgcgcgatatcatcaaacacacgccggatttgctcagtgtgcgctggaagcgggaagggtttatttccgatcacgcggcgcgtagtaaaggcaaagagacgccgattaatttgctgggtttcaaagacggcactgccaatcccgatagccagaatgataagttgatgcaaaaagtggtgtgggtaacggcagatcagcaggagcctgcgtggacaatcggtggcagctatcaggcagtacgcttgattcagtttcgagtggaattttgggacagaacgccgctgaaagaacagcagacgatttttggccgtgataagcaaaccggtgcgccgctgggaatgcagcatgagcatgatgtgcctgattacgccagcgacccggaagggaaggtgatcgcgctggacagccatatccggctggcgaatccccgcacggcggagagtgagtccagcctgatgctgcgtcgtggctacagttattcactgggcgtcaccaactccgggcaactggatatggggttgctgtttgtctgctaccaacacgatctggaaaaaggcttcctgacagtacaaaaaaggctcaatggcgaagcgctggaggaatacgttaaacctatcggcggcggttatttttttgcgctgccgggggtgaaggacgcgaacgattatttcggaagcgcgttattgcgggtttaatgtttttaggcggataaggcatttgtgcgcagatgcctgatgcgacgcttgcgcgtcttatcatgcctacaatcagtgcgggtttggtaggctggataaggcgttcacgccgcatccggcgatcgtgcactgatgcctgatgcaaatcctgctgaaagcacacagcttttttcatcactgtcatcactctgtcatctttccagtagaaactaatgtcactgaaatggtgttttatagttaaatataagtaaatatattgttgcaataaatgcgagatctgttgtacttattaagtagcagcggaagttcccggcagtgatagtcagtcactatggagatcgcggatggtaacgtcctgtactggacatgttttagataatcaacgcgccaccactcgcggagttttctcctccggtagtcatctcgtcactttgcattttcaacctcatcctttcttttcatgtgttaccgacgccgtaaacggtgcgcgtagccgtttttcggcattttatccaaaagcaaactatggcttacaaggaagccaaccctctgatgttcgtgcgcataatcgcgctgccaacggcgcgtgtgatgaatacaaacaactcaaggtgctctccatgggaagacaaaaagcagtgatcaaagctcgtcgcgaggcaaaacgtgtgctgagacgggattcgcgcagccataagcagcgtgaagaagaatcggtcacctcgcttgtgcagatgggcggcgtagaagccattggtatggcccgcgacagtcgcgatacttcgcccatcctcgcgcgaaatgaagcgcaattgcactatctgaaggctattgagagtaagcagctgatattcgccacgggcgaagccgggtgcggaaaaacctggatcagcgcagcaaaagcggcagaggccctgatacataaggatgtcgacaggattatcgtcacccgtccagttctgcaagccgatgaagatcttggcttcttacctggagatatcgcagaaaagtttgctccctattttcgcccggtctacgacgtgctggtccggcgcttaggggcttcctttatgcagtactgcctgcgaccggaaatagggaaggtggaaattgcgccgttcgcctatatgcgtggacgtacctttgaaaatgcagtcgtcattcttgacgaggcgcagaatgtgactgccgcgcaaatgaaaatgtttttaacccgcctcggggagaacgtgacggttatcgtcaacggtgatatcacgcaatgcgatttacctcgcggcgtgtgctccggattaagtgacgcgctggaacgtttcgaagaagatgaaatggttgggatcgtccggttcggtaaagaggactgcgtacgttcggcactttgccaacgtacgctgcatgcctacagttaagtgtgttatcggtgcagagcccgggcgaaccgggctttgttttgggtgtttatgcccggactagcgctttttctgaaacaaccatttttatttgcccctggctggtgaagtgtacgctcatcctgtggcttttttgtagttgctgatagagctcatcaggtattgctaagctctctgcatattcttgcggcgtatattggtaggctgcatgatgctgctgtttttgaaaacgcagcttattgtacagcgcccagacaattaacacgacggcattcgccactgccagcaaaaaatagaactgaagtcggcttctggcctcgctttgccagtaataacccgtcagcagatccatggcgaataagaatatgaacaacgcaaataatgtccacaagatggttgtggcaacataatcaaccagtaaacgtactggtgattgtcgggtcgtaataattaaattgttcatattaacctctcagaatcccgcgatcgggacttacccaacgggcgcgttgctttttaggcatcaacatgactcgtgtaaatgataccaatgtcgttgccaggctcagcatccagaaaataaccgggaaccaaataatccagaaaagcgatgaagtcagattatgctcatagcgattctcgatcatcaggctgacaataaattgcagtaaacataacgtacacaataatattccggcagtatgtgtcgcagcgatatgtgtcaattcaatatttaacggtacaccggcaagttggactgcgtaaataatgaaaccgaccaggcaggtgaaggcccatattgtcgtcaggcagtattcaaaaaacagcggccacattcgaaagttttctttgcgccacaaccttgtcatatttttgaggaatacttctgcaccgccctgagcccagcgcaggcgctgtttccacagcccttttaacgtttcaggcattaatatccagcacagtgcccgtggctcgtaaaaaatcgtccactgattcaactgcagcttccagctaatatcaatatcttcggtgatcatatcgtcactccagtaacccacttctgccagggcgctgcgacgaaatgcggcaataacaccggaaacggtaaatacgtttccatagatacgctgggttcgcttgatcaaaccaataattgaggaatactcgccaacctgaattttacccaccagggtagaacgtgttcgaatacgaggattaccggttacggcacccacacgcgggttgtacaacatcggttccacaatatatgccgccgcatcgcggtctaataacgcatcgccatcaatgcacaccagatattcacttttcgccgcggcagctccggttttaagcgcaatggctttcccctggttttgcgccagatgaatgacccgcaaatggggaatttgtgcagccatgcgatccaggatggcacgggttttatctgttgaaccgtcatttacggcaataacttcaatgttctcataacgctgtgctaaagcggcgtgtatggtttcctcaacgtttttctcctcattaaaacagggaatgataatggagatagacggattatctttcaactggggagctggtgcgttttctccccacggccagtggcgttcacgatagacccagaaatagacgccgccaacaatccacataatggacataaaaaacggccagaagaaaacgaacctcatcatcagttcaccagagtgaaagtacgctacgcataggggtatgcataacaccagacataatataaaaaacgatacgatgcgattaatcatttttcggataccaggctgttgaaaactcaggacgaataaggtctatttcaggttggttatgcagaaaattgtcgggataataaccatagtttttcactccattcagttgtaataggctcatccagtgagcgagttgttgcgaagaaatagcctgatgctgaccatttttctgccagttttgtgcctgtaattctaaaatagatttgtctttagcctgagggatgtttttaatttgattggtcaattgtattaaccattggtcagccgatttttctgcgacaccttccagataaggcatagccataatagcggtccagtcatagctttttaggaaatcagcataattctgtgcaaaccaggcttcactttcaggttgtattaccggaagtgcaaaaatatttcgtgcagttttaatatgtggaccgcgaatggcttttacgcgcgcactaagttctaaagtgaagtcagttaacgcacgacttttaaagcgggcccactgtttaaattgctccgggttttgtcgaatttcgctcagactcccgctaaagcctgcttgctgataagccgtgatagccggtgcactggcatcttcataatctgaaagcaaagcatcatcgtggaacaatatgccatcaaaagcagcatgtccggcaagatcttcatataacatgccaacttgtgctctgactctgtcatcgaaaggagagagacggtgatattgttcaggatgaatttgtgcttttttctcccctgttggtaagtattttactcgcgttaatgtgggatctaaatcccagcttaataccggcatccacgcatagatgtttacacctgagcgggtacgtaattgccaggcaacccgactaaaaatatctgctttcattggtagcaaacgatttggaaaccagacctctttgaccagcccatcaccatcgggatcagcaaatgcctgcaaatacacggttgatatttgcatatctttcacccgctgaattagcacatcaatattgcgatccatttgctggaggttttcgtcataaacgtaatcaagatcgatatgcattatccgttgtggtgatttttcctgtacggtaataatttgctgggcaaactcttttaatgagggattattggcgattaatacccgcggaatggaatccaattgcgacgcatttgccaaacctgattcaagggtgaagaacatgtcataaccgagtttttttaattcctctatcgctatgccattcgcttcgccataaggccaaacaaaaacgtgtggatttacctcaacctttgtacgcaggtattccgtcatttttacagcatccagacgaattctttcccggtattctgctgcggtttcataccgtgcgtggtcagtaaaatatgcacgatttacatatacaggcaataagctgccggtggcattagcctgaataccgtagtgagaattccatgtatgagaagcgagctcaacgagccgggaacgcgcaacttctcgcacttgttgccacgtggcaaaatattctcgatcgaccaactcatcgccaaattttacttgtttatccgctggcgtatcgacccaactgccgacgggggcccatacagcaggccactggaaggcctgaagaattgggaagacgcgggtataaaaactctggtagccgtcatcaaaagtcagcactacagctttttccggtagcggttttcctcctcgacgtgcttcacgaatttgagcaatactgaccggttgataaccgttctcgcgcagccaggcaaattgttcacgcagtgctgatgtccgcactgacataaaacgctggtcggcagcttcgtcttcaacgttatgccatgaaatcgctacaaaaccattatgcggccacggttgctcggcgagtaaagattcgcgatcctgtggcggtataaatgatgttcttgactggctaatgcacgcggtgagcataattatactcaccagcatcaggagatatttatttccattacgtaacatatttatccttaaaatctgaatgtcatatcgaattcaacgtataagttgtgttctctgtcaccgtcataaggtcgtttttcccagcgtagcgttgcgccagcatcaatcacgtcattccaactaatgcgttgcccgtagccgagttgggtgacgacatccgtgccataatgtttttgccaggaggcaccaacacctgcgctgaatatttgctcccagctattttcatagcttcgccataacaaatggcttgcctcaaatgccggaacaatatcgaacgtttttatagggttgtagtatggggtatcgtgttctgtattttgttcgtaatacagactgggtaggaaatcgacaatcaaatatggtgaagaccagatgcgttcctgaccctcaagtgagacttcatgacgctggttactgtcggaaaaatcagtgaaagcccaggagacaccgtacttacgccgctcattttgataccagcgaacataagcctgagcactgttgcctgtaacaccatttttcattgcccgtaatggaacgcggtgagagaggcgttccagttgcgaaccaatacgccagttatcattaaaatcataccagccagacaggcgcgcgccgggtttatgctcatgattgaaaacgcgttcagcgtactctgcctcgagccagatattacgtgaccgccactcaacacccgcaagccagtcgcgaacaatcccttttccttcgctaaattgtccatcggcataaccgaatccagcaaaaccgcgccagttatccttcagcggtggtgaataaacgatggtggttaagtcgacatcatgtttaccactatccgggccttcggcatcaattcctgttgagccagcgatacgaagctctgcaagattatgtacatcaaccgcacgttttaatcgtacaacgccgggatcttgcggttcacgttcgacaacatcgtgcgttaagacagctgcctgctgccattcttgtaacgttaatgctgtccaggcttgttcaacctccagattaatattacgtggctcgatcacttctgctttttttaattcattttctgctgcacgaggccggtaatgactccaacttattgatagtgttttatgttcagataatgcccgatgactttgtcatgcagctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgctcaccgaatacgtgcgcaacaaccgtcttccggagactgtcatacgcgtaaaacagccagcgctggcgcgatttagccccgacatagccccactgttcgtccatttccgcgcagacgatgacgtcactgcccggctgtatgcgcgaggttaccgactgcggcctgagttttttaagtgacgtaaaatcgtgttgaggccaacgcccataatgcgggcagttgcccggcatccaacgccattcatggccatatcaatgattttctggtgcgtaccgggttgagaagcggtgtaagtgaactgcagttgccatgttttacggcagtgagagcagagatagcgctgatgtccggcggtgcttttgccgttacgcaccaccccgtcagtagctgaacaggagggacagctgatagaaacagaagccactggagcacctcaaaaacaccatcatacactaaatcagtaagttggcagcatcacccacgaggccaaccgcgggcttgtaacacactcgcgtaatcaatgcgcagtccctgatttcctggtgcgttataagcaagccctctggctgtcatttcagcctgaggaagatcattactatattttgctacggttgagagaaacgaatgcccctgtaaccaggtatcattcgggatgctcgtaggcgtgcccattaaccgaaggaaaggcggcgaagtattaatggtatgttgggtgacagttagcgcgcccggataattttcactctccaggtggctgtaaaagagatccgcaagttcttcatcggataaatccggggcaatggtctccttgtgataaaagagctcggtcattattgactgtgcttttttcggctgatgatctttgagataagccgatgcaacccaatattgcccccagggcggaataatttgccccgtcttttttaatcgctgatagtgagaaataacgtctttataacgatcgcgagttaataacgcgccaagatgatcaacctgaatacgctggtactgggcagtgcggtctgggttatcgtgccacagaatttctaatgcagcgtattgggcgagggcgcgatcggcaatggcataacgttcactttcactgcgcgtaggcataaacgacagtctgaccagttcggcatgaatatcagcgcgaatatctggcgttaaattggcatcgtcaatcgcggcagcaagttgattattacgtaatgcctgcacgtattctgtgggatattgttgcgtagatgcattttcaggtaatgactctgtcatcgcccgtaattcatcctgatgacgccccgccagtttatagatataggcttctgcgagtaaattggctttgtccggtgctccagagttaagctgcttaagtttaaccagcgcagtatcatagtgaccagcatctgccagggttaaaatttgtccccgttgataatccttattttgcggctccagagagagcgccttttgccacagtgtaagcgagttttgccattgttgcaggttacgataagcgacggcgacagctgcataaccacgcgctggtaattgctgatgacggtagcggttgtaaacggtaataacctgtttatcttgcccggcccataaggcaatctgtaaccagtcagcaatttggttattgctgagtgctgattttagtgcaaaccatgacaaagctggctgagtattacccttgcgagcttcaataatcaatgcatcataggcgttattaacagcactcttcgccgcgggactcgctgctaaaaatgcggcagtaagaagtttcaaagcccatttggttttcgggcacctttttctgctacttgaatacatcctgtattactccatgtattgccaaaatctctctctgtatctaattacaggtaactgaaaagaaagatatttttgcacctcataatccgttattaaacgcggaagagagacgtgaattgttgatgatgagaagaagaaatgatgagcagagtgtccatataaaatccttttctcgcccgaaaatccattccaatgatgaggatcttcaggaatacggcataaatcccaatgcctttttcaaaataaattaggattaaaataattaaatcagtaaattccgatgcatgatttcggatttttcgaaagtcctgatgaaaggctgcgctacggcactcacggatttaattgttattcctaatgtatctatgaattaatgttttataaggattttctataaccatttataagtattttcaagcctggcttgttgcaaacaatgtataaagcacttaggcaataataattacattcagcaactatcatcatcggtattgtttgtgggcggaatttcatattgacaacagtacagttcttatatctattaataatagaaagggatctacaacctacagattggtgtagctttatggaaaaagactatttgagaattagtagtactgtattagtgagcttattgtttgggcttgctttggttttggtgaatagttggtttaatcagccaggcgttgaggaagttgttccacgatcaacctatctgatggtaatgattgctttattttttatcgatactgttgcatttatttttatgcagttgtatttcatttatgaccgtaggcaattttcaaactgtgtacttagtttggcttttctgagttgtttgatttactttgttaaaaccgtcattatcattcagcaaattattgaggagcgtttgacaagcagtgttgtccaaaatgacattgcaatctattatttgtttcgtcagatgagtttgtgcatattaatatttctggcattggtgaataaagttagtgaaaacacaaaacagcgcaatttattttccaaaaaaatgactttgtgcataagtttgttttttgtttttggggggccgatagttgctcacatactttctagtcattatgagagctacaatttacacattgccgagttaaccaatgaaaatggtcaggtggtttggaaagcctcatatgttaccataatgattttcatgtggttaaccttgctttcggttaatctatactttaatggtttacgctatgatatctggaatggagtgacggtgattgctttttgtgccgtactgtacaatatctctctgttatttatgagcaggtatagcgtatccacttggtatattagtcgcactattgaagtagtcagtaagttaaccgttatggtaatatttatgtgccatatattcagtgcgctacgagtaacaaagaacattgcacatcgcgatcccttaaccaatatatttaacagaaattatttttttaatgaactgacagttcaatcagcatcagcccaaaaaacgccttattgcgtcatgattatggatatcgaccacttcaaaaaagtcaacgacacctgggggcatccggttggcgatcaggtgataaaaacagtggtgaatatcattgggaaaagcatacgaccagatgaccttttagcgcgcgtcggcggcgaagagtttggcgtcttgctgacggacatcgatactgaacgtgcgaaagctttagcggaaaggattcgggaaaatgttgagcgtttaactggcgataatcctgaatacgctataccacaaaaagtgacgattagtattggcgctgttgtgactcaggaaaatgcgttaaacccaaatgagatctatcgactggctgataacgcactttacgaggcgaaagagaccgggcgtaataaggtggttgtgagggatgtggtgaatttttgtgagtcaccataaagcggcattttgatcctacccacgtaatatggacacaggcctaagcgaggttcttgttttcaaattgttccggactgaggccgccacaccaactgtgccgccgccaccgattgtaatcacattcgatataattaaacaccgttgcccgcattatttcccggctgataaagtgttctccatggatacattccactttcagcgaatgaaagaagctttccacgcaggcattatcgtagcagcaaccttttgcgctcatacttccacgcagattatgccgcttcagttgcgcctgataatctgctgaacagtactggcctccacggtccgtgtgaacgataacgttccggggcctcttacgccgccacagcgccatctgcagggcatcgcaggccagttgcgccgtcatgcgtggcgacattgaccagccaataacggcacgtgactacaggtcaatgaccactgccagatacagccagccttcatctgtacgtaagtacgtgatgtctcctgcccacttctggttcgggccactggcgtaaaaatcctgctccaacagattttctgacacaggcaggccgtgtgcgcggtagctgaccgggctgaacttccgggaggcctttgccctcagtccctgacggcgcaggcttgccgccacggtttttacgttaaaggggtaaccctgagcacgcagttcatccgtcaggcgtggggcaccgtaacgctgttttgaccgggtaaaagccgcgaggacaacgctgtcgcagtgttggcggaactgctgacgcgtgcttatccttgtccgccgctgacaccacgtataccagccgctgcgggccacccggagcacgcggcacattgctttgatgctgaactcagcctgatgtttttcaataaagacatacttcatttcaggcgcttcgcgaagtatgtcgcggccttttggaggatagccagctcttcatcccgttctgccagctggcgtttgagacgtgcaatctcggtagacatctccagttcacgttcagaagacgtctgctgattttgctgtttactgcgccagttgtagagttgtgattcatacaggctgagttcacgggctgcggcagtaacaccgatgcgttcagcaagcttcagggcttcactgcgaaattcaggcgaatgctgtttacggggttttttactggttgatactgtttttgtcatgtgagtcacctctgactgagagtttactcacttagccgcgtgtccactattgctgggtaagatcagtgcctggcacacgcgtttgatggaagacggcgttcaggcaatgcgcgattatcttgccggactggatatcgcttcgccagagcatcaggttctgatgaacgtaacagcaaaaagcgaggtcgctccgtcaattatcaaagaaaatctctcattacacttaactcatacggtgaaatggactgaatctctcgatacatttctgaatatgccaaccccggtagctttccttgaaataagtaataagccctatttggggaatatgttaaatgattttgctggcgtggatcagcaacgagttatgcattgtcgtaaagcatttagtgatgcaaaggtattcaaatgattcctgattatttaacttttattcgctttcaggataaacgaaatctgatatacatttatgctattggacttattctgataggcttttattggaagaatgcagggtttatttttccatcagaggatattggtgtagttagtgggattctggctctggtgctgtataattttatttttgatctcaaggcgtactgggcttataaatgcgtcacgaagaatatcgatttttcgtggtttaagaaaaagcagaaccacaaaatagaattatttcttacacaacctctggtggcaggatttctgtcgttaatcatgttgagtgcaatgagttgggggctataccagcttctaccctcgttatatgcgctgttcctgatttcgttacttgggccgttggtcatctttctgctgtttcggatgatccgcaccagttatgtcaagcaggtcgctatttcagtagcgaaaaaagtaaaatataaaagtctgactcgctatgtgctgctttcggtgtgcatctcaacggttgttaacctgcttactatcagcccgttgcgtaacagtgattcttttgtgacagaggggcagtggttaacgtttaaatcgataattgcattgctcattctttgtggcgtagtgttggcgattaatctgttttttctgcgcttctccaagcggtacgcttttctgggcaggctttttttgcaggaaatcgatctgtttttctccagtgaaaatgcgttgtcgaccttttttgccaagccgctttggcttcggttattcatattgctggttattgaagtgatgtggattacgctggtgtcggtattggcaacgcttgtggaatggcggatttggtttgaagcctattttttactctgctatgtaccgtgcttaatttactattttttctattgtcgattcctctggcataacgattttatgatggcatgtgacatgtatttccgttgggggcattttaataagtgaggaagtgataggaagtgaccagataatacatatatgttctgtactctcttgcgcattttgattgttgactgagtaaccagacagttgatgtgcacgatttcccctcgccctaacagacgtgggcgggggcacccggtgtgtgcaatatacgaaaaaaaagcccgtactttcgtacgagctcttctttaaatatggcggtgagggggggattgactcgcttcgctcgccctgcgggcagcccgctcactgcgttcacggtctgtccaactggctgtcgccagttgtcgacccccggtcggggcttctcatccccccggtgtgtgcaatacacgaaaaaaaagcccgtactttcgtacgagctcttctttaaatatggcggtgagggggggattgactcgcttcgctcgccctgcgggcagcccgctcactgcgttcacggtctgtccaactggctgtcgccagttgtcgacccccggtcggggcttctcatcccccccggtgtgtgcaatatacgaaaaaaaagcccgtactttcgtacgggcttttttttaaatatggcggtgagggggggattcgaacccccgatacgttgccgtatacacactttccaggcgtgctccttcagccactcggacacctcaccaaattgtcgttcctgtcttgctggaacgggcgctaatttagggaaatcatgacctgaggtcaacaaacttttttaaaaaatcgcgcgtttattcaaacttcaatcaatatgcagttttaataagcgaaatctgctttttttgccaccgaccacggatttgttatgctggtggcttttgtagatcataacgataagtgcgaataaatttcgcacaacgcttttcgggagtcagtatggatatcatcttttatcacccaacgttcgatacccaatggtggattgaggcactgcgcaaagctattcctcaggcaagagtcagagcatggaaaagcggagataatgactctgctgattatgctttagtctggcatcctcctgttgaaatgctggcagggcgcgatcttaaagcggtgttcgcactcggggccggtgttgattctattttgagcaagctacaggcacaccctgaaatgctgaacccttctgttccactttttcgcctggaagataccggtatgggcgagcaaatgcaggaatatgctgtcagtcaggtgctgcattggtttcgacgttttgacgattatcgcatccagcaaaatagttcgcattggcaaccgctgcctgaatatcatcgggaagattttaccatcggcattttgggcgcaggcgtactgggcagtaaagttgctcagagtctgcaaacctggcgctttccgctgcgttgctggagtcgaacccgtaaatcgtggcctggcgtgcaaagctttgccggacgggaagaactgtctgcatttctgagccaatgtcgggtattgattaatttgttaccgaatacccctgaaaccgtcggcattattaatcaacaattactcgaaaaattaccggatggcgcgtatctcctcaacctggcgcgtggtgttcatgttgtggaagatgacctgctcgcggcgctggatagcgggaaagttaaaggcgcaatgctggatgtttttaatcgtgaacccttaccgcctgaaagtccgctctggcaacatccacgcgtgacgataacaccacatgtcgccgcgattacccgtcccgctgaagctgtggagtacatttctcgcactattgcccagctcgaaaaaggggagaaggtctgcgggcaagtcgaccgcgcacgcggctactaataaagcatcaggattcctgctatccttggcgggaattgaatacaggagagagttatgtatcccgtcgaccttcatatgcataccgttgccagcacacatgcatatagcacattgagtgattacattgcccaggccaaacaaaagggcattaaactttttgcgatcaccgatcatggcccggatatggaagatgctccgcatcactggcacttcattaacatgcgtatctggccgcgagtggttgatggggtagggatcctgcgcggcatcgaagctaacattaaaaatgttgatggtgaaattgattgcagcggtaaaatgtttgactcgctggatctgattattgccggttttcatgagccggtttttgcaccacatgacaaagcgaccaatacacaagcgatgatcgccactatcgccagcggcaatgtgcatataataagccatcccggaaatcccaaatatgaaatagatgtgaaagccgttgctgaagcagccgcgaaacatcaggtggcgctggaaatcaataattcttcatttttacactcacgtaagggcagtgaagacaactgtcgtgcggtagccgcagcggtacgtgatgctggaggttgggtggcattaggctcggattctcacaccgcgtttaccatgggggaatttgaagagtgtcttaaaatcctcgacgcggtagattttccgccagagcgcattttgaatgtttctccgcgccgcttactgaacttccttgaatctcgcggtatggcaccgattgcggaatttgcagacctttaattactagtaatggaaatatattaatgaacgagttttctatcctctgtcgtgtgctgggttcgctctattaccgccaaccgcaagatcctttactggtgccgctgtttaccctgattcgtgaggggaaactggctgcgaactggccactggagcaggatgagttactgacgcgtttacagaaaagctgtgatatggcgcaagtctctgccgattacaatgcgttgtttatcggcgatgaatgtgccgtgccgccatatcgtagcgcatgggttgaggacgcaacggaagcggaagtgcgcgcttttctttccgaacgagggatgccactggcggatacgccagccgatcacatcggcacattgctgcttgcggcttcctggctggaagatcagtcaacggaagatgagagcgaagcactggaaacactgttcagtgagtatctgttaccctggtgtggtgcgttccttggcaaagtggaggcccatgcaaccacgcctttctggcgcaccatggcaccgctaacccgcgatgccattagtgcaatgtgggacgagctggaagaagattctgaagaataagtgtgatctacgtcactcataactgcaacggataatttgttgttgcataaaatgtgtgctcgatctcattcatggccgcgttttctgctatcatgcgcggcatgaacatacttctctctattgcaatcacaacaggcattctctccggtatctggggatgggtggctgtttccctgggcttactaagctgggcgggcttcctgggctgtacggcctactttgcctgcccgcaaggtgggctgaaagggctggcgatctccgctgcaaccctgcttagtggcgtggtgtgggcgatggtcattatttacggtagtgcactggcaccacatctggaaattctcggttatgtcataaccggtattgtcgcgtttctgatgtgtattcaggccaaacagctgctgctttcatttgttccggggacgtttataggcgcatgcgcgacgtttgccgggcagggtgactggaaactggtgttaccttcgctggcgcttgggctgatatttggttacgcaatgaaaaacagtggcctgtggctggcggcgcgtagtgcaaagacggcgcaccgtgagcaggaaatcaaaaataaagcgtgaggggcactcacgctttcgcttaaacagtaaaatgccggatgataattccggcttttttatctgtcaggattccggtggaaccgacatatggcggtatttcaccagaatgtcattctgccgttctgctttattttgcaaatcccacagaccacggtcgataccatcattaatcaggaaaatgacccctgtttcgatagccgacatcaggcacagcataacaggttcgttcgaggtgtaacccacttccccttcaagcaagcgctggtagtcaataaagcagaaaaccccggcctgaacttcataggaaagtatcgtcttactggtgttcaccgaagaaaggatctcgccggtactcacattgacgacgcgcaggttcacggcaatctgatcgagctggtattgcgtgtcggcaccgatgccaaaatatcttgccccaaccccgccagatttgacgttgctttcataaccgataatcgaaccttcaaccatgatatttgccgccgttaaagattgcagcgggattcggttattaatggcaaccgtgccgttttcttgtgccgcacgaataatcttgcgctcgttaagcaggttttgtaagccctggcgctccagcggtataaaccagcgagaatctttaagtgccgtgaccagcattgccgtggcgctttgcggaacagcagtggagaagttacttgccgggtagggtttaaattgcccggtttcgtcctgaatgttgtataccgaaacaaagattttacccgtcggcgctggcagatgggtcaaatctttgtagctctgagcacgaggcgttaatgtcggtctggcggcttctttaggcggggcggttaagcatccgctcagtaacatgacggcaaccaaaagaaataagcgctgcatgattattttccttatgaagctggggcttaaaaatcggttgagttattttgtaaacccgaaacctggatggtcgaggtttgtccggttttacgatctgtcacgttcaactgcaattgaccatcgcggttggcaatatcgacaatataatcgttggtcaccatgcggcccggtttaccggtattaatattcgacagtagcccacctaaaatttgtgactggatggcctgagtaaagttatctaacgctgagggtatttcaataccaaagtcatcgttatagctcggatctttataagagttttgggcctgagcgctatttaataaaaaagcgccattatttgggttaccaccaaagtttggattacggaactggaaagtcatggttccagcccaacttaatggcgaaataagcatgagtagaactactgcatgtttgacacgcattgcagcctccgaacaattttttatttagaattcatcatgcgccaaatcgcccgtacttaataacgcctgatttatctggcgacgatttagtgcttcttcagtttgaatcagtgcaaagacgacagttttctcgaagtctcttttcaacggaaataaaaaagtctggaaaataacgtcctgattgaccgttatagtgatccagcttccccatcgtgcactgggcctttcattaatcgttaagttacccgtatagtcactttcccatttatcactaaaggctcggtaaaaatcatggccaatagatgaaacagtatggtcagttagcaatcccgggacttctacctcaacggcgtgaagattccctgcggcgaacagaaattctgccgccacaatccagcgtaaataacgtttcatggctttatcgcctgaggttatcgtttgcccaggaaaccgcttgtgtccggttttttacggctatcttcttgaaaagattataaagatgcgttttaaccgtattttcgctgatgaacaacgaacgagcgatctcgttattagacgcgccgatacgcagcttattcaggatctctttttcccgatgagtaaggagggctgattccgtgctgttataacgatagttacctgaatgcgtaatcaggtagctggcaagcttttgcgtaaagtagcattcgccgcgcaggacgccttgcaacccattgacaacacgttcttgatcctccatggaataaaaaacgccgttgatatgaggccagttttcaatgtcgcggtacgggtaatcttcaggcgtatttagcaacaatattttgatattgttgtttttcctgctcaaagtatcctgccaataatggataagctttttatccgcttccatcatatccagaagaataatagagcctgaagagatatcgtccagagaacgttgaatattatgtaattttcctgtaattgccagcgattgtttaaggtgctgcaagagagctgtcgcctgcaaagaaggtttagtgatcaacaataatgtatgaccatgaatactatggacttcattaaacatgatgaaaccccgctttttttattgatcgcacacctgacagctgcctctaaaatagaagcaccagaagtactgacagatgttgcactgctgtgtgtagtaataaatcagccctaaatgggtaaaatataaaactaatggattacatctgatttcaatctagccattacaaatcttaaatcaagtgttaaacatgtaactaaatgtaactcattatattaaaatgttaaccttaaggttttattaagtttagaaatgatagaaaagttgtacatttggtttttattgcacaattttaaaaaatcatacaaatggtgataacttactaataatgcatataaaaaatatttcggtgtagtcctttcgtcatgtaaaacgttcttgttttttctccacacctccgtggacaattttttactgcaaaaagacgaggtttgtcacggcttgtgcgcaagacatatcgcagcaatcagcgacgggcaagaagaatgactgtctggtgctttttgatagcggaaaacggagatttaaaagaaaacaaaatatttttttgcgtagataacagcgtatttacgtgggttttaatactttggtatgaactaaaaaagaaaaatacaacgcgcgggtgagttattaaaaatatttccgcagacatactttccatcgtaacgcagcgttaacaaaatacaggttgcgttaacaaccaagttgaaatgatttaatttcttaaatgtacgaccaggtccagggtgacaacatgaaaaacaaattgttatttatgatgttaacaatactgggtgcgcctgggattgcagccgcagcaggttatgatttagctaattcagaatataacttcgcggtaaatgaattgagtaagtcttcatttaatcaggcagccataattggtcaagctgggactaataatagtgctcagttacggcagggaggctcaaaacttttggcggttgttgcgcaagaaggtagtagcaaccgggcaaagattgaccagacaggagattataaccttgcatatattgatcaggcgggcagtgccaacgatgccagtatttcgcaaggtgcttatggtaatactgcgatgattatccagaaaggttctggtaataaagcaaatattacacagtatggtactcaaaaaacggcaattgtagtgcagagacagtcgcaaatggctattcgcgtgacacaacgttaatttccattcgacttttaaatcaatccgatgggggttttacatgaaacttttaaaagtagcagcaattgcagcaatcgtattctccggtagcgctctggcaggtgttgttcctcagtacggcggcggcggtaaccacggtggtggcggtaataatagcggcccaaattctgagctgaacatttaccagtacggtggcggtaactctgcacttgctctgcaaactgatgcccgtaactctgacttgactattacccagcatggcggcggtaatggtgcagatgttggtcagggctcagatgacagctcaatcgatctgacccaacgtggcttcggtaacagcgctactcttgatcagtggaacggcaaaaattctgaaatgacggttaaacagttcggtggtggcaacggtgctgcagttgaccagactgcatctaactcctccgtcaacgtgactcaggttggctttggtaacaacgcgaccgctcatcagtactaatacatcatttgtattacagaaacagggcgcaagccctgttttttttcgggagaagaatatgaatgcgttattactccttgcggcactttccagtcagataacctttaatacgacccagcaaggggatgtgtataccattattcctgaagtcactcttactcaatcttgtctgtgcagagtacaaatattgtccctgcgcgaaggcagttcagggcaaagtcagacgaagcaagaaaagaccctttcattgcctgctaatcaacccattgctttgacgaggttgagtttaaatatttccccggacgatcgggtgaaaatagttgttactgtttctgatggacagtcacttcatttatcacaacaatggccgccctcttcagaaaagtcttaatttgttgaaatatcgagcataaggtaatgactccaacttattgatagtgttttatgttcagataatgcccgatgactttgtcatgcagctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagcctgtcatacgcgtaaaacagccagcgctggcgcgatttagccccgacatagccccactgttcgtccatttccgcgcagacgatgacgtcactgcccggctgtatgcgcgaggttaccgactgcggcctgagttttttaagtgacgtaaaatcgtgttgaggccaacgcccataatgcgggctgttgcccggcatccaacgccattcatggccatatcaatgattttctggtgcgtaccgggttgagaagcggtgtaagtgaactgcagttgccatgttttacggcagtgagagcagagatagcgctgatgtccggcggtgcttttgccgttacgcaccaccccgtcagtagctgaacaggagggacagctgatagaaacagaagccactggagcacctcaaaaacaccatcatacactaaatcagtaagttggcagcatcacccgagcataagatgaatctggagagaatggtctgctgcgaatcagccaacctgaaagtatggataacacaaccctcaaggatgactaatcattgaggaaatagaataaatgttcagaccttttttaaactctcttatgctcggcagtttgttttttccttttattgccattgctggaagcaccgtgcaagggggcgtgatccatttttatggccaaattgtggaaccggcatgtgacgtcagcacccagtcatcacccgtagaaatgaactgcccacagaatggttctattccgggcaaaacctactccagcaaagcgttaatgagcggcaatgtcaaaaacgcgcaaatagcctcagtaaaagtgcagtatcttgataaacagaaaaagctggctgtaatgaacatcgaatataactaagtttctgaacaactcacgttgctgagcagaaaaatgcgatttaaccaaaaagcctgctgtacacttaagaaacaagaaggtgtaaggaggcgttatgaaaacgcgtattcatgttgtgcagggtgatattaccaaactggccgttgatgtgattgtgaatgcggctaatccgtcattaatgggaggcggcggcgtcgatggggccattcatcgcgcagcgggtccggccctgctggatgcttgtttaaaagtcaggcaacagcagggcgattgccctacggggcatgccgttattacgcttgcaggcgatcttcctgctaaagccgtagtgcacaccgtcgggccagtctggcgtggtggtgaacaaaatgaagaccagcttttgcaggatgcctatctcaatagcctacgactggtggcggcaaacagctttacgtcagtggcttttcctgcaatcagtactggggtttatggttaccctcgtgcggcagcggctgaaatcgcagtaaaaaccgtttcagaatttattacccgtcacgctttacccgaacaggtatactttgtctgttatgatgaagaaaacgcccacctctacgaaagactccttactcaacaaggagatgaatgatttgccccggctggcgagcgcggtgctgccactgtgttcgcaacatcccggtcagtgtggcctttttcctctggagaaaagtctggatgcgtttgcagcccggtatcgtctggccgaaatggcagagcatacgctggatgttcagtattacatctggcaggacgatatgtcgggtcggttactgttttccgccctgttagccgcagcaaagcgtggcgttcgcgtccgtttgttgctggacgacaacaatacgcccggacttgacgatattttacgcttgcttgacagccatccccgcattgaagtccggctttttaatcctttctcgtttcgcttgctgcgtccgcttggttatatcaccgacttttcccgtctcaatcgccgtatgcacaataaaagtttcactgtcgatggcgtggttaccctggtgggaggacgaaatattggtgatgcctattttggggcaggggaagagccacttttttcggatttagatgttatggcaataggacccgtggtagaggacgttgccgatgatttcgcccgctactggtattgcaaatcggtttcacccttacagcaggtgctggatgtcccggaaggtgaaatggcggatcgcatcgagttacccgcctcctggcataacgatgccatgacgcatcgttacttacgccaaatggaatccagtccgtttataaatcatctggttgatggaacgttgccgcttatctgggcgaaaacacgtttattaagtgatgatccggcgaaaggggagggcaaggcaaaacggcattcactgttaccgcagcgcctgttcgatatcatgggctcacccagtgaacgcatcgatattatctcttcctattttgtaccgacacgcgcaggtgtggcgcaactcttacggatggtgagaaaaggggtaaagattgcgatcctaaccaattctcttgccgctaacgatgttgctgtcgtccatgccggatacgcgcgctggcgcaaaaaattgctccgctatggcgtggaattatatgaactcaagccgacgcgtgaacaaagtagtacgttacacgatcgcggcataaccggtaattccggagctagcctgcatgctaaaacttttagcatcgatggtaaaacggtgtttatcggctctttcaatttcgatccgcgttcaacattgctcaatactgaaatgggcttcgtgatagagagcgaaacgctggcacagttaattgataaacgctttattcagagccagtatgatgcggcctggcagctccgtctggacaggtggggacggatcaactgggttgatcgtcatgcaaagaaagagattattctcaaaaaagaacccgccaccagtttctggaagcgggttatggtcagactggcgtcgatattgcccgtggaatggttattgtaaatgtggcttaacgggctggtgctttatcgttctcacgcttaacaaccggtttaccagaaaacaaaaacttcagtaacgggatgcgtaaatgaatttcatacagaattatcgcaatccctactacgaatatcaggccacagagaaaaccaagccagttggaggtgatgtgcggtgtaatgtatgcgccgaaaaacagcgttaacgggtggtgaaccagatagataaatagcgatgcgttaacaaagtaagtcacccgcgctgactggaagttaagcaaacggtggccaaaggagaagaccacattcaccatccacagaccgaggaccatggtgatcactgactcggtttcgtacatccaggcatcgccactgccatagcgctggttgagtaaataagcgacaaacgccaatgctgcagcgagggtacagccacgagacggcgtggtaaacaaggctttaagatgagggaaaatgaaagccagtgcgccgaggataaagaacggtaaataaaatagcgtttgcatgacaataaaattgaacatgccattactcagaatgggcggatacacaataaaaatcgttcttcttattaccgcataaccgatgccgaggcacaaaaaaatcaccgatagttttaccatcgagaattttttattcgttttatcagaattttctaaattatttctgatgcgtttaaatatccatacgcacagcgtcgtcatgaccactaacaccagtaaaaaccacaggtgtgatattaattcccaggccaacgtattatatttgtcatacaatgacagcccaggccaactttccgctttccctttgacgtattgcagcataataaattgcggcaatgtcagtaaggggatggctgttaacatcgggatacctacacgttcgacacgtactttccaccattttttcaagggatagcgtaaaaaaagcatgtaggaaaagtagccggatataacgaaaaatacctgcatgcggaacgagtggatgaagtcattaaaaagggtcagccacaatgacggttcggcgctattcacatgccatgtatggctcgaatagattaaagaaatatgaaaagggatccctaacaacatcagccaggcgcggatggagtcaaggaaatattcacgttgcgcgggtactggattcatatatggttaactaatctcggatttttcgtcttatccctgtcgggttatgcctttaggcttgttgccatagcgacaccgacctgaccgcgccaggcgcaggcttcaaggtttttatgcatagcatcatcgcaaccactaaccagaatggaagcgtctgtaagacggttgataaataaaattgctggcaaaccctacacgaagtcgatgcttctgtctttaggagaagcacggaaagtgaaaacggttgcaatcaggtgcttaatccatgagccagcgtgctgaacgataccgggattctgttgtcggaatggctggttatccattaaaatagatcggatcgatataagcacacaaagggggaagtgcttactaattatgaaacataaactacaaatgatgaaaatgcgttggttgagtgctgcagtaatgttaaccctgtatacatcttcaagctgggctttcagtattgatgatgtcgcaaagcaagctcaatccttagccgggaaaggctatgaggcgcccaaaagcaacttgccctccgttttccgcgatatgaaatacgcggactatcagcagatccagtttaatcatgacaaagcgtactggaacaatctgaagaccccattcaaactcgagttctaccatcagggtatgtacttcgataccccggtcaaaataaatgaagtgactgccaccgcagtcaaacgaatcaaatacagcccggattatttcactttcggcgatgttcagcatgacaaagacacggtaaaagaccttggttttgccggttttaaagtgctttacccgatcaacagcaaagataaaaacgatgaaatcgtcagcatgctcggggccagctatttccgcgtgattggtgcaggtcaggtttatggcctttctgcccgcggcctggcaattgataccgccttgccatcgggtgaagaatttccacgcttcaaagagttctggatcgagcgtccaaaaccgactgataaacgtttaaccatttatgcattgcttgactcgccgcgcgcgacaggtgcttacaaattcgtggttatgccagggcgtgacacggttgtggatgtgcagtcgaaaatctatctgcgcgataaagtcggcaaactgggggttgcaccgttaaccagtatgttcctgtttgggccgaaccaaccgtcgcctgcaaataactatcgtccggagttgcacgactctaacggtctgtctatccatgccggtaatggcgaatggatctggcgtccgttgaataacccgaaacatttagcggtcagcagcttctcgatggagaacccgcaaggcttcggtctgttgcagcgcggtcgtgatttctcccgctttgaagatctcgatgatcgttacgatcttcgtccaagcgcatgggtgactccgaaaggggagtggggtaaaggcagcgttgagctggtggaaattccaaccaacgatgaaaccaacgataacatcgtcgcttactggacgccggatcagctgccggagccgggtaaagagatgaactttaaatacaccatcaccttcagccgtgatgaagacaaactgcatgcgccagataacgcatgggtgcaacaaacgcgtcgttcaacgggggatgtgaagcagtcgaacctgattcgccagcctgacggtactatcgcctttgtggtcgattttaccggcgcagagatgaaaaaactgccagaggataccccggtcacagcgcaaaccagcattggtgataatggtgagatagttgaaagcacggtgcgctataacccggttaccaaaggctggcgtctggtgatgcgtgtgaaagtgaaagatgccaagaaaaccactgaaatgcgtgctgcgctggtgaatgccgatcagacgttgagtgaaacctggagctaccagttacctgccaatgaataagacaactgagtacattgacgcaatgcccatcgccgcaagcgagaaagcggcattgccgaagactgatatccgcgccgttcatcaggcgctggatgccgaacaccgcacctgggcgcgggaggatgattccccgcaaggctcggtaaaggcgcgtctggaacaagcctggccagattcacttgctgatggacagttaattaaagacgacgaagggcgcgatcagctgaaggcgatgccagaagcaaaacgctcctcgatgtttcccgacccgtggcgtaccaacccggtaggccgtttctgggatcgcctgcgtggacgcgatgtcacgccgcgctatctggctcgtttgaccaaagaagagcaggagagcgagcaaaagtggcgtaccgtcggtaccatccgccgttacattctgttgatcctgacgctcgcgcaaactgtcgtcgcgacctggtatatgaagaccattcttccttatcagggttgggcgctgattaatcctatggatatggttggtcaggatttgtgggtttcctttatgcagcttctgccttatatgctgcaaaccggtatcctgatcctctttgcggtactgttctgttgggtgtccgccggattctggacggcgttaatgggcttcctgcaactgcttattggtcgcgataaatacagtatatctgcgtcaacagttggcgatgaaccattaaacccggagcatcgcacggcgttgatcatgcctatctgtaacgaagacgtgaaccgtgtttttgctggcctgcgtgcaacgtgggaatcagtaaaagccaccgggaatgccaaacactttgatgtctacattcttagtgacagttataacccggatatctgcgtcgcagagcaaaaagcctggatggagcttatcgctgaagtcggtggcgaaggtcagattttctatcgccgccgccgtcgccgcgtgaagcgtaaaagcggtaatatcgatgacttctgccgtcgctggggcagccagtacagctacatggtggtgctggatgctgactcggtaatgaccggtgattgtttgtgcgggctggtgcgcctgatggaagccaacccgaacgccgggatcattcagtcgtcgccgaaagcgtccggtatggatacgctgtatgcgcgctgtcagcagttcgcgacccgcgtgtatgggccactgtttacagccggtttgcacttctggcaacttggcgagtcgcactactggggacataacgcgattatccgcgtgaaaccgtttatcgagcactgcgcactggctccgctgccgggcgaaggttcctttgccggttcaatcctgtcacatgacttcgtggaagcggcgttgatgcgccgtgcaggttggggggtctggattgcttacgatctcccgggttcttatgaagaattgccgcctaacttgcttgatgagctaaaacgtgaccgccgctggtgccacggtaacctgatgaacttccgtctgttcttggtgaagggtatgcacccggttcaccgtgcggtgttcctgacgggcgtgatgtcttatctctccgctccgctgtggtttatgttcctcgcgctctctactgcattgcaggtagtacatgcgttgaccgaaccgcaatacttcctgcaaccacggcagttgttcccggtgtggccgcagtggcgtcctgagctggcgattgcactttttgcttcgactatggtgctgttgttcctgccgaagttattgagcattttgcttatctggtgcaaaggaacgaaagaatacggcggattctggcgcgttacattatcgttgctgctggaagtgctgttttccgtgctgctggctccggtacgcatgctgttccatacggtcttcgtcgtcagcgcgttccttggctgggaagttgtgtggaattcaccgcagcgtgatgatgactccacttcctggggtgaagcgttcaaacgccacggctcacagctgctgttagggttagtgtgggctgttggtatggcgtggttggatctgcgtttcctgttctggctggcaccgattgtcttctcgttgatcctgtcaccgtttgtttcggtgatttccagccgtgccaccgttggtctgcgaaccaaacgctggaaactgttcctgatcccggaagagtattcaccgccgcaggtgctggttgataccgatcgcttccttgagatgaatcgtcaacgctcccttgatgatggttttatgcacgcggtgtttaacccgtcatttaacgctctggcaaccgcaatggcgaccgcgcgtcaccgcgccagtaaggtgctggaaatcgcccgtgaccgccacgttgaacaggcgcttaacgagacgccagagaagctgaatcgcgatcgtcgcctggtgctgctaagcgatccggtgacgatggcccgtctgcatttccgcgtctggaattccccggagagatattcttcatgggtgagttattacgaagggataaagctcaatccactggcattgcgtaaaccggatgcggcttcgcaataaaaacgtagttgcctgatgcgctacgcttatcaggcctacatcgttcctgcaatttattgattttgcaagattttgtaggttgggtaaggcgttcacgccgcatccggcaaaaacaacgagccaataaaaataccggcgttatgccggtatttttttacggaagaggtatcaaatgcgtttaattgtggtgagcatcatggtgaccttgctgagtggctgtggcagcattattagtcgcactataccggggcaggggcatggcaaccaatattatcccggtgtgcaatgggatgtgcgtgactccgcctggcgttatgtcacaatccttgatctgccattctccctggtttttgatactttactgctgccgatcgacattcatcatggcccgtatgagtgattaacgttcatcccactcatcagctgctgcgcatccttcctcggtatccagcggtggctcaagctgaaattccccctcgtcccattcatgtaatgtattctcttcctgccactcctggcgtatctctatctcatcatagtcgccatcaaaaacactttgcgcggcttcaccgctaagcataggtaaacattcaccttcttccccttcgtcggcaaaaaactcaacttgccacatgatgtcgccgtcctgcaaaacgtatttttgggcattgaactgttgcacattcgcatcttcggcgtcgatgccggggttgtctgcaagaaattcttcgcgtgcagcgtcaatggcttcttcaagcgttgcgtacatggtcatcacgattctccctttgagttgatgaggtttcagggaaaaggatagctgattctccgcttttgcaagtatgaaaggcgaaaaatcagttcgatacctggggtattcgacgacgacgtagactgttccatgaatagactgcgttgaataacactacgccagcggtgacgagaaataccgctctgaaaccgtagttcgctgaaatcgctgctcccatcaatggtccggtaacgttgccaatatcacgaaacgattggttatagctgaagatacgcccggcgatctggttgctcgagttgtaaaccaacagtgtctgtacggcggggagtagtgcaccatcggcggcaccgagcaaaaaacgtaaaatcccaagttgcaatggcgtctgaacgtaagacattgggatcaacagcagtacagaaaagatcagcgctgtaatcaggatcttttcgggtccgattcgatcgccaagtttgccgagtcgtggtgcacttagcagcagagccgccacgcctggcaccgaggcgatcatgccactgataaaggcgacgttactgacgttacccgccagttcgcggacatacagcgtcagaatgggggcaattgagcccgtcgccacctggatgattaacgtagtgacaaacaggctgagtaccagtttcgggtttttaagtgatgtcaccacttcccgcatgtgcagcatctcttttttgctgaccggctggaatttttctctgatgcaaaacagggtgacgaaaaagcagagtatgagcacactggcggtaataaagaataccggacgtaagccgtagctatcggcgagcaggccgccagccattgggccgagcaacgcaccactaacgccgcctgtggagagcgtacccagcgcccagccgcttttattacgcggtacttgtgtggcgataagagcattagcgttggggacaaatccgccaagtaacccaagaagcgcccgtaggatcaaaaactgccagatattttgtgccagtcccatcaacaccattacgatgcccatgccgagagcagagcgtaatagcatgagttttcggcctttacggtcggcgagtccaccccaaaacggtgaggcgatggccgaaaataaaaatgtaatgctgaagacaataccggaccacatattcagggcggagtgaccggtaacgccaagctgctcaacgtagaggggtaagaagggcattaccagactgaaggcggccccggtaagaaaacagcctagccaggcgacgatcaggtttcgtttccagtttataggggtgtcattttcacagggtgacatagcaatccgctgttggtgcgccaggcgcggtgaacataagaagaaaagataagcacactaattatgcgcccgacttccagggggcgcaatccagagagcttttatcgctaaatcagggggatttgctgtggtaatgccggatgccattctgaagcatccggcatgggagatttaatagcgtgaaggaacgccttccgggcgtgttttaaagcgacggtgtaaccacatatactgctctggtgccatcatgatgcatttttcgaccactttgttcatccacgcggcggtagtttcggcatcatccagtggcggagaacactctggcggcagcataatcaattgataccctttgccatctggcttacggcgtggaacgaagggcaccagacatgcgccggacatccgtgccagcatccaggttccggtcgtggtcgcagcctgctcaacggcaaacaacgggacgaaaacgcttgagcgcgggccgtaatcatgatccggtgcgtaccagaccacttcgccttttttcagggctttaatcatgccttttaaatctttgcggtcgagcatcgatttatttgagcgcaaacggccccaggtttgtagccagtcaatcagtggattatcgttcgggcggtaaacgccaatccccggttcctgcataccaaactgccgcgcacccagctccagtgtcagaaaatggatgccaactaacaggatgccgcgtttttgcgcctgcacgtcacgaatgtgttccatgccgatcacttccgtccagcgggcgattcggcggtccggccagaaccacgccatgccggtttccatcaggcccatgccaacggattcgaaattcttcaccaccattttacggcgttcttgttcgctcatttccgggaagcacagttccaggttgcgatgcacaatttttgcgcgtcgtttcataaaacgtaacgccagttttcctaatccacaaccgaggcggtagataaccgggtagggcaattgcacgactaaccaaagtacgccaatacccaaccaggttaaccaataacgcggatgaagcagtgcggtggagaacttgggtagattcgtcatatcaatcctgtttttcaacctattcgggcaattgtatgtattgtcgcattttttcgcccgcaaccaaaatttgtggctgaagactgggcgaaattgccgcgcttgtaaataacaaataatttttaatgcgcaaatgtagcgtaaaatgtgtggatgttaattatcgataattgctatatcatgccgcggatttttactttcccatctcgcaggaaccgtacaccatgccagtgttacacaaccgcatttccaacgacgcgctaaaagccaaaatgttggctgagagcgaaccgcgaaccaccatttcgttttacaagtatttccacatcgccgatcctaaggcgacccgtgacgctttatatcagctgtttaccgcgctgaatgtttttgggcgagtgtatctggcgcatgagggcattaacgcgcaaatcagcgtacctgcgagcaatgttgaaacatttcgcgcgcagctctatgccttcgactcggctttagatggcttacgcctgaatatcgcgttggatgatgacgggaaatccttctgggtactgcgcatgaaggtccgcgatcgtatcgttgccgacggtattgacgatcctcactttgatgccagcaatgttggtgagtatctgcaagcggcggaagtgaacgccatgcttgacgatcccgatgcactgtttatcgacatgcgtaaccactatgagtatgaagtggggcactttgaaaacgcgctcgaaattccggcagataccttccgtgagcagctgccaaaagcagtcgagatgatgcaggcacataaagataaaaaaatcgtcatgtactgcaccggcggcattcgttgtgaaaaggccagtgcctggatgaaacataacggattcaacaaagtctggcatatcgagggcggaattattgaatacgcccgtaaggcgcgcgagcagggcttgccggtgcgttttattggcaaaaattttgtttttgacgagcggatgggcgaacgtatatcggatgagattatcgcgcattgccaccagtgcggcgcgccgtgcgacagccataccaactgtaaaaatgatggctgccacctgctgtttattcagtgtccagtatgcgcggaaaaatacaaaggttgttgtagtgagatttgctgcgaagaaagcgcgttaccgccagaagaacagcgacgccgtcgggcaggacgtgaaaatggcaataagatctttaataagtctcgtggacgtctgaatacaacactgggcattcctgatccaacagaataaatatcattgccggatgcgtgccatccggcaacatttcacgcttacttctgctgtacgccttccactgaaataatcagatccacatcctgagaagctggacctaaatctgtcttgatattgaagtctttgagcttaattttgccttcggcctcaaagcctgcacgtttaccgccccacgggtcgtcgccctgaccaattaatttcgcttccagcgtgacgggtttggttacgccattcagtgtcagatcgccggtaatatccagttcgtcaccgtctttcttcacgctggtggaggtgaatgttgcctgtggatattttgcggtattgaggaaatctgcactgcgaagatgtttatcgcgttcggcgtgattagtatcgacgctggtggtgttaattgtcacattcactttatcggcagccggatttttttcgtcaaaggtaaaagtaccgtcgaaatctttaaaggtgccgtataaccagctatagccaaggtgctggatgcggaaattaacaaaggcgtgctgaccttctttgtcaattttgtaatcggcggcaaccgctgaaccggcagagaacatcagggacgcgaaggttaaaccaagcaggctttttttcattttttatactccatagtcagatgacgactttcccagcatgcgcttcagagtgtcgtctttatcgatgaaatgatgcttcagggccataaatccgtgcataacggacagtactacgacgctccacgcgagccaaaaatgcagggcaccggcaaagtctgcctgtgcgccagcgtcggcaagggtcgcggggacgtcaaaccagccaaaaacgctgatcggtttaccatcggcagttgagatcagatagccgctgatgccgattgcgaacagcaataggtacaatgcgagatgtccagcttttgcggcaagacgagtcatgggcgaataactcggcagcggacccggcggtggagatatgacacgccacagaacgcgaataaccagccccatcattaacaaaataccgatgcttttatgcagttcgggtgctttgtgataccagccatcgtaataactgagcgtgaccatccacagacctaaagcaaacatgccgtagacaataattgcgcttagccaatggaaggccgcagatataacaccatagcgttcaggggtatttgtgaatgacataagtgcatccaaaacgaatttgcgagagaaagaaaatggcgtgtcggagaatgaattgcaacacaaaaataacaaattgaatgatatttatttttatttcaataattttgaattaataatgaaagaatcttcataagtttagtgggttcagcatcagagatgtctggtgagtgctgtagaagcaggaataatctcattcaatttttcacgctaaatgaaagggagattaaatatttgtcagtttatgtcagtgcggaaaactaaaaataaaacacatagatcagatccataattgccaacaatccccagagaaaaagataaagcatcagatgctcgcgaatattattgatgagatagtgcaacagccgacgcattaaatactcctgtaaaaacggcctcattctggaggccgtaatgatgattattggaagcgggaaagcctgaatggcgttaaatcaaaatcgctttttttgtcttgcgcaaaatcggcagctatttcccctaaaacagacgcaaatttaaaaccgtgcccgctcaggccggtaatgagcagtgtattatcgtgaccgggtagggtatcgataataaaatcttcgtcaggcgaattatcataggtgcaggcagcgccgtacaggcagcaaccgatacccggcaagacattgcgcaagaacgggaaggcttccgaaccatcgctgaccacttccgcaaacggaacacgttcatccgctgaatggataacctggcctccgttatgtttgccaatcttcaacgcgtcgttttctgccggaaaaccataatattgatcgccattgggcagttcaccggtaaacgccgggaatttattcttcacgctatagcgaccatcggcctgataccaggcaaatactttgcgtacgggctggacaggcagctccgggagcaggtcttttacccatgttcccgcgcagacaatcgcttttttcgcctgatactctccgtcagccgtttcaatagttacgccatcatcgtcatgacgaattgcggtgaccgggcagttgaacagctgcgcacagcccgcttccttcgccagttgtatccaggttttaatcgccagttcgctgcgcaaaaaaccggaatcagtctcaaataagccgatgtagttgtccgggacgcgtatttctggccagcgggccataatcccttgcgcgtcgagcttttcgacgttgagttgccactgttcggcgctgtgggcgacgttggcgagaaatgcggagtcagccgggccgaggttaatgacaccagagcgtacaaaaatgggatcatcttcgttgtggcgggagagctcatcccacagtgtttgcgcgcggagtaccagtgggacatacttttcgccttcaccataagcatggcgaattaatcgcgtatcgccgtggtggctgccgtgttgatgcggtggcatatgggcgtcggtcattagcacgtttaaaccggcgcgggttgcataatacccggcggcagcgcctacggaaccgctgccaataatgatgagatcgtatttcatttttttctctctgctctcatggtttaagcagagtaattaactgaatgcagatatacaacccagaaatggtaaaggcaccggtgaggtgccttttgggtggatggtcatgtcatgttaatgacgccgatactcgtttaccgggaaatcaccggattcaattttggcgattcctgcttctaatatcgaaataaattgtctggcaacatcagtggttaaccagagcgtctgaccaacttcagtcccttcctgctcggacttatttggggtctggtagtgcaaacgcaacatcagcgcatcatagctatcaacggtgctgatgtcccaccctacgagcggatgagtctgaatgacttcattatttttttccatcatggccccctaattcgtgttactagacaacgttattcgaggttcaatgcgtttttatctgaagcaacttcagtataccaataagtaagggtattcaccgaatttttaaaggggggaacagataaatttctgcttttaagatttatatgaacaataaaacagcatgtcattcatatttttttagcatattgtgcaattattttgaggaagtgtagaaattttgtactcaaaattcgtaagtaaaataaaaaagccggggcgacccggcaaaaacaaaaatcactgcatattattcgctgacaaaccagtcatcggcgctttcccacgtttcctggagaatttcgctaatgcgctgtttatcttcttttgttgcgccaataaccgataaattattcgctgcggcataacgtaccgatacgtggccttcattatcaggaaacgcatactgaatacggcgggaaagttcgccagccagggcgtcaatagccccagctggcaatggagaagttttcgctatggtgacttcaattcgcataatagccccctgttgaatatactggttatttatacaggtaaaataacctaatgacaacaggaagctacgatttttattgtttaacggaccagcgtaccgtttccccggcgaggaatggcaccagggtgtcatcagtcagtgcgatgctttcagcaacctgttgctcttcacgtaccagttcgatgaatgtgtcgttgaccggcaagccatagaactgcgggccgtttacagaacagaatgcttcaaagtgctgcagagcattcatctcttcaaagacggtagcgtaactgcccagcgcggttggggcgttgaagcagcccgcgcagccgcaactgctctctttgcgatgacgtgcatgtggcgcagaatccgtaccgaggaatactcgattaaaaccgctggcgaccagttcacgcaatgcctgttggtgaatattgcgtttgaggatgggtaaacaatacaggtgcggacgcacgccaccaaccagcatatggttgcggttaaacatcagatgctgcggagtgatggtggcagccagccgttcatttccgtcacggacatagtcggctgcgtctttggtggtgatgtgttcaaaaacgactttcagtgcagtcaggcgctggcgcagcggttccatcacgctttctataaagcgcgcttcacgatcaaaaatgtcgatatctgcatgtgtcacttcaccatgcaccagtagcggcataccgattttttccatgcgctcaagtaccggcatgattgcgtcaactgacgtaacgccgtggctggagttagtggttgcgtttgccgggtaaagttttgcagcggtgaacacgccttcgttaaatccgcgctccagctcattaggatccagcgaatctgttaaataacaggtcatcaatggggtgaaatcgtgcccggcaggtacggcatcaagaatacgctggcgatacgccacggcagcctcaacggtggtcacgggcggagccagattgggcattacgatagcccgtccataaatttcgctggtatacggcacgacagtttttaacatgtcgccatcgcggaggtgaaggtgccagtcgtctgggcggcggatctttaatacctgggatggtgcagtcattaatctctatgctccggctgaagggatgtttttgccggacacaaaggataagcggaaacgttttcctttgcacgaaaaataaagggcgcgaatgcgccctcgtcattaatccgtaaacggaatgacaatttcgcctggcttcacttcaatgcctttcgccagttttttcgccattgcttcgccctgactgccatcttcgcgcaggacgtaagcaggttgctggttaaagtaattgcgtaatgcctggttcaaatagggaagcaacgtttgcatcaccgtttgcattttttccggttgtaccgtcgcatcgaccacttccatctctttcaggaagatcgcacctttttctttatcaaacacgggcagcgctttcagcttcagtttcatggtcgctttctgactaccgaacagggagttcatgtccagattggcgtctccggttagggtaaccttattcggctcttcgcgaccaatttggctggtcaagtttgtcagaacaatatgggcgtcagccacgccgggtaaaccgatatcttttgagaaattattatgtttcgcaagcgactggttaatttcttgttcggtgatggtgtattgggtgagttgattacagccaacgagcaggccactgacgatcaatgcagcggcaaataaaaacttgttcatggtagtcctcgacatgaaatctgcgtcaatatcctgacacaacgcagcatgtgtcaccagcgataaactcgccagcagaaaaaactgaaaacggcggcaacccgcgaatacaggctgccgcggcgggtcaggattaaatcgccattgatgataacaaattgatttgtgtctgtttcgccatattatcgcggtaatcagcaacgcggcttggccagttgattccggctaccagcgtcagattacgcagtagcggaaatagctgaatatcatcttccgaaagttcgccattcacggcgttcggtttgacgatcagtttgtccagcgcacgcaaatcatcgctgatattcttaatcagaccgtcagagtgggccagcaggtcggcaaaattacccgcgctggcctctttcttgtcgacgaaatatttgcgcgcggcgggagtagaaaactcatcaaatgccgatttggcaaaacgcggcaacagcagtttgttggcgtagccattgactttgcgcagccactcttcaatggcaggggaacgtttgccggtcagtaacggtttgccgtcgagtttatcgacatagtgaacgatatccatgctttctggcatatagcggctgtcatctttttgcagaatgggaacctgtttttgaccgaccatccgggtgggtgtttctgcgtcgtcgttgagcagaacatgtaattcgacggggatatttttcaggccgaaaatcatgcgggctttgaggcagtaagggcagtgatcgtaaatgtatagcttcacgtgactcctccatttggctgtcagttcactttcagtatggaggagtcaggggggagtatcaaatcaggcgtcgcgttccagcaaacgacgcgcggcgcgtttttgactaaactgccaacccagcgcaaggaaagtgaagatgccaataattcccagcatcatccacggaagctctggctggtgcgccgatttgcccaggtcaaacagccagccgccaccgatataaccaatagcgccaccaatcgccagacccagacggctaaaccccatatagctgccgcgagctcttgcgtccgccagcgaagcacttaaggtttcacgcgcaggctcggcaatgatcgacccgatataaaacagacaaatcaggttgaaaagttgttgcaggccgctgaccatgcccaccggcatcatgcttaatgacattatcaacagcccagccatcaaccggtgttccagacgaaaatgcttttcactccagcgggcgatagggtagagcaacgttaacgacagacacgcttcaatggcatacatccatttaacggcagagggcgcgccagccacgtcgttgaccataattggcagcatcagcatcacttgtacagccagcatgtagtaacccgccagcgtcagaacataggtgacaaaacgcttgtcgcgcatcacgcgggtcatgccttcgcgaacgggcgtgcgtacggtggagagtttccatgccggtaacaaccacgcattgaacgccgcacacagcacaaacaaaacggcccctgtggcgcagaccaggcgaaagtcgtattgcaacagccagctccccaacaatgcgccaatgaccgcaccggcactgtcctgcatcatcaacagcgagaaaaaacgaccacgttgttgtggacggattagtttcaccaccagcgccgaacgcggcggatcaaacaacgtgccgccgagtcccgagagcaggcatgaaaaccacaatagccacggttcgtgggcgatacccattgtggcgaatccggcggcgcgcatcagcataccggtaacaatcatcggtttggcaccaaagcggtcggcaattgcgccgccgaaaatacccagaccttgctgaataaactggcgtagaccgagagcaataccgaccatgacggcggcccagcccatttgatcaacgaagcggatagagatcagcgggaagacaacaaagaaccccagcacgaccagcatattatcgatgagcaggaaatatttacccaggttcctcgcctgcgatacgcgggacatttcccctcccgggaaataaaagatgagcactttctattctgcattgccgctaagacttttcccatcacttcggggacaatatttttttatcaaaacgtcgctttgatagagagtttttatcaaatatgtgaataatgcagacaatggcattttggacttttcacaggggctggttgcgcaggtatagtaatacttacagcgtattaaagacgttacgggaaggagtaggtatagaatgtttggctatcgcagtaacgtgccaaaagtgcgcttaaccacagaccgactggtcgtgcgtctggtgcatgatcgtgatgcctggcgtcttgcggattattacgcagagaatcgccatttcctcaagccctgggagccagtgcgcgacgaaagccactgttatccatcaggctggcaggccaggctggggatgattaacgaatttcataaacaaggttcagcgttctactttggcttattcgacccggacgaaaaagagattattggcgttgccaatttttccaatgttgttcgcggctcttttcatgcctgctatctcggttattcgattgggcaaaaatggcagggcaaaggactcatgtttgaagccctgaccgcagccattcgttatatgcagcgcacccaacatattcatcgcattatggctaattatatgccgcacaataaacgcagcggtgatttactggcacgactgggttttgaaaaagaaggctatgcgaaagactatctgttgattgatggacaatggcgcgatcacgtactgacggcattaactaccccagactggacgcccggccgctaaggagaatctcatgaaatatcaacttactgccctggaagctcgtgtgattggttgcttgctggaaaagcaggtgaccacgccggagcaatacccgctctcagtcaatggtgtagtcacggcctgtaatcagaaaacgaaccgtgaaccggtcatgaatctgagtgaatccgaggtgcaggagcaactggataatctggtcaaacgccattatctgcgcacggtgagtggctttggtaatcgggtcaccaaatatgaacaacgtttttgtaattcagaatttggcgatctgaaactgagcgccgcagaagtggcgttaatcaccacgttgttattgcgtggtgcccagacgccgggtgaactgcgcagccgcgccgcgcgaatgtatgaattcagcgatatggcggaagttgagtcgacgctggaacaactggcaaatcgcgaagatggtccttttgtggtgcgtctggcccgcgaaccgggtaaacgtgaaagccgctacatgcatcttttcagtggtgaggttgaagatcagccggcggtaacggatatgtcgaacgcggttgacggtgatttacaggcccgcgtcgaagctctggaaatcgaagtggcagaactgaaacagcgtcttgattcgttgctggcccatctgggagattaaagtgaaaaaattacgtatcggcgtagtgggattaggcggcattgcgcaaaaagcgtggttaccggtgctggcggcagcgtctgactggatgttacaaggagcctggtcgcctacgcgcgcgaaagccctgccaatttgtgaaagctggcgcattccttatgccgattcgttatccagccttgccgccagttgcgatgcggtttttgtgcattccagcaccgccagccactttgacgtggttagtacgttactcaatgcgggggtacatgtctgtgtcgataaaccgctggcagaaaatctgcgcgatgctgaacggctggtggaactggcggcgcggaaaaaattgacgttgatggtcggttttaaccgtcgtttcgcaccactctacggtgagttaaaaacgcaactcgccaccgcagcctcgctaagaatggataaacatcgtagcaatagcgtcgggccacacgatctttatttcacgttgctggatgattatctgcatgtggtggataccgcgctgtggttgtcgggcggcaaagtctctatggatggcggtacgctactgactaacgacgctggcgaaatgctgtttgccgagcaccatttttcggccggtcctttgcagatcaccacctgtatgcatcgccgtgccggaagccagcgtgaaaccgtgcaggccgtgactgacggtgcgctcatcgacattacggatatgcgcgaatggcgtgaggagcgtgggcagggcgtagtgaataaaccgattcctggttggcagagcactcttgagcaacgtggatttgtcggctgtgcgcggcacttcattgaatgtgtgcaaaatcagacagttccgcaaaccgccggcgaacaggcagtgcgggcgcaacgtatcgttgacaagatctggcgcgatgcgatgagtgaataaaccctgtaacatctggcggtagcaattcaccataatccaggtagactattcgcctctttcagcgcctgccttgcaggcgttttgcccgtgggtctggattagaacaccgatgaatttattaaaatcgctggccgccgtcagctcgatgaccatgttttcgcgtgtgcttggcttcgcacgagacgcaattgtcgccagaatctttggcgcagggatggcaaccgacgcctttttcgtcgcttttaaacttcctaacttgttacgccgtatctttgccgaaggggcattttcccaggcatttgtaccgattctggcggaatataaaagtaagcagggtgaagacgccacgcgggtctttgtctcttatgtttctggcctgctgacacttgcgctggcggttgtgacggtcgctggcatgctcgccgcaccgtgggtgatcatggtgaccgcgccaggcttcgctgacacagctgacaaatttgccctgaccagccagctactaaagattacctttccctatatcttgcttatctccctggcgtcgctggtgggagcgattctgaatacgtggaaccgcttctcgattccggcgtttgcgccaacactgcttaacatcagcatgattggtttcgcgctgtttgccgcaccgtactttaacccaccggtgctggcgctggcgtgggctgttacggtcggcggcatcctgcagttggtgtatcagctaccgcacctgaagaagatcggcatgctggtcctgccgcgcattaacttccacgatgccggagcaatgcgcgtggtgaaacagatgggaccggcgatccttggcgtctctgtgagccagatctccttaatcatcaacaccatttttgcctcgtttcttgcttccggttcggtgtcttggatgtattacgccgaccgcttaatggagtttccctccggtgtgctgggcgtggcgcttggcaccattttgctgccatcgctgtcgaaaagttttgccagtggcaatcatgatgaatacaaccgtttgatggactgggggttgcgtctttgtttcctgttggcgctgccgagtgcggttgcgttgggcattctttcaggtccgttaaccgtttcgctgttccagtacggtaaatttaccgcgtttgatgcgctgatgacccagcgggcgttaattgcctactcggtgggtttgattggcctgattgtagtgaaagtgttggctcctggcttttattcccgccaggacattaaaacgccagtgaaaattgccatcgttacgctgattttaacgcaattgatgaacctggcgtttattggtccgttgaaacatgccgggctgtcactttctattggtctggcggcgtgtctgaatgcttcgctgctttactggcagttgcgtaagcagaaaatctttactccgcaacccggctggatggcgtttctgttgcgtctggtggtggcggtactggtgatgtctggcgtgcttttaggtatgttacatatcatgccggagtggtcattgggtaccatgccctggcgcttactgcgtttaatggcggtcgtgctggcggggattgccgcgtacttcgctgcactggcggtactgggcttcaaagttaaagaatttgcccgccggacggtgtaacaatgcattccggcctgcagtgcaggccggagataatattcagatcgaaatctttttaccgccgcgatgggttgttgaggtctgaccgttcgccccatatagcgtcggttcctgatgcggtttcaacatttccagcgcctgttgattgcgctcaatctgtccttccagtaaccagccgttatgttgattcatttggcgtagttgctgcgttttcacagtaatttcctgccagcgttgactaatatcaacgctatttgctgtattgggttctttcttgcgtaactgttcgaggtaatccagcgtcgccagcagtgagcttttttgttctgtaatccattgcaactggctgccgttgatctgccccatagagagatgttgctgctcttgatccattaccgttttgagatcgttaagcacagcggacatctggtcgaggatctctgcaagacgtgtcatacgatcagttactctgcaaatcttgctgagcttcgttgatcagcgcatcggcaattttgccggtgtccatttttagttcaccgttacgaatcgccagttttaacgcttcgacacgttcaagattgatatcactgctgccgggttgcatcagttttgcttgcgcgtcgcttaacgtcacactggtgctggtggaggcggttgtttttgccgcccggctgttcgttaccggcgcgtcagtggtttcgcgcggttgaacggtgcttacaggcttcagaggcgaagtgcgatcaatactcatggtttattcctcattgagggcgcttttatcatgtgttgcttatttatcggcaagggacgggtaatctttaacagcttacaggtttataagaatattcccatctgcatcaacaacgccgctgactacctgtcccgataccatgcgcacccgcgcattctgtgcgacggctgcattgttcagcgcctgaccttctgcgttggcgctaaacccatcaccgctggcgatcacgttgacgcgttgtcccgcttttacccgccatgcctggcgaaactgggttaactggataggttgatcgggtgatagatcgcgcaggctaatggcatcaacaagttgattgatatccagcaccgtacgcggtggcagggtatccagccgtccgcgtttcagtttgacattgccagcttccagctttcctccccgcgcaatgggcatcgcggcaaccacataatttcctgtggcctgtacattaacctgtaaatatcgtttgtcgttaccgcagcgtgccaacacattcacattgccccacaggcgggaattattgctcatcgaaagcaatggctgctcgcacggcggtagtagattgggcgctgtacgaatagaaacacgaacctcatcacttacccccgcgagctgggcgctaaaaaaggtttgcaattgcgatgtgagattgctcgccgcacttaacggactgaacagtatcgcaatgatcgccacgctacgttttattgccagcattttcgccccccagccatttctacaacgtgaattgtacctgtccgcaatggtcatcaacggcataaatagcgacccattttgcgtttattccgccgataacgcgcgcgtaaaggcatttaagctgatggcagaattttgatacctgcggaggagatatgctcgataagctcgacgccgccttacgttttcaacaagaggcgctcaatctgcgcgcccagcgtcaggaagtgctggcagcaaacatcgccaatgccgatacccctggttatcaggcgcgcgatatcgattttgccagtgaacttaaaaaagtcatgcaacgtggacgggatgcaaccagtgtggttgcactgacgatgacctcaacgcaacacatcccggcgcaggcgctgacgcctcctaccgcagaactgcaataccgtattccggaccagccttcgcttgacggtaataccgtcgatatggatcgcgaacgcacccagtttgccgataacagcctgcaataccagatgagccttagcgcgttgagcgggcaaatcaaaggcatgatgaacgttttacagagcggaaattaacggatggcactgctgaatatttttgatatcgccgggtcggcgttaactgcccagtcccagcgcctgaacgtggcggccagtaatctggcaaatgctgatagcgtgaccggtcctgatggacagccatatcgggcaaaacaggtggtattccaggttaacgctgcaccaggtgctgcgacaggcggcgtaaaggttgccgatgttatagaaagtcaggccccggacaaactggtttatgaaccgggtaatccgctggcagatgcaaagggctacgtaaaaatgccgaacgttgatgtcgtcggggagatggttaacaccatgtcggcgtcacgcagctatcaggccaatgttgaagtgctcaacacggtgaaaagcatgatgctgaaaacccttacgctcggtcaataaaggagaaagctatgtccattgcggtaaccaccaccgatccgacaaataccggcgtcagtaccaccagcagtagttcgctcacgggcagcaacgccgcagatttacaaagcagttttctgactttgctggtggcgcagctgaaaaaccaggacccgaccaatccaatggaaaacaacgagctgacgtcgcaattggcacaaatcagcacggtcagcgggattgaaaaactcaataccacgctcggctctatttccggacagattgataacagccagtcgttacaggccagtaacctgatcggtcacggcgtgatgatccccggcaccactgttcttgcgggaaccggtagtgaagaaggggctgtgaccacgaccacgccgtttggtgttgagctgcaacaggcggcagacaaagttacggccaccatcaccgataaaaatggcgcggttgtgcgcaccattgatattggtgaactgaccgccggagtccacagtttcacttgggacggtacgttgactgacggcagcactgcgccgaacggttcttacaacgtagcgattagcgccagtaacggtggtacacaattggttgcccagccgctgcagtttgctctggtgcagggtgtgatccgcggcaacaacggtaatacgctggatctcggcacttacggcaccaccaccctcgacgaagtacggcagataatttaagccttcacatttcaggagtcagtcatggccttttctcaagcggttagcggattaaacgctgccgccaccaacctcgatgttattggcaacaatatcgccaactccgccacctacggctttaaatcaggcacggcctcttttgccgatatgtttgccggttcgaaagtgggactgggggtaaaagttgccggtatcactcaggactttaccgatggcacgaccaccaacaccgggcgcggtctggacgttgctatcagccagaacggttttttccgtctggtagatagcaacggttcggtgttctacagccgtaacggacaatttaagctggatgaaaaccgtaacctggtgaatatgcaaggtttacagctgacgggttacccggcaaccggtacgccgccgactattcagcaaggggcgaatccgactaatatttcgatcccgaataccctgatggcagcgaaaactaccactacggcgtcgatgcagatcaacctgaattccagcgatccgcttccctctgttaacgcatttgatgccagcaatgcggatagctataacaaaaaaggttcggtgactgttttcgacagtcagggtaatgctcatgacatgagcgtctactttgtgaagaccggggataataactggcaggtctacacccaggatagcagtgatccaaacagcattgcgaagacagcgacaacactgaaatttaatgctaatggcacattagtggatggtgcgatggcgaataatatcgcaaccggcgcaattaacggcgcagaacccgccacgtttagcctgagcttcctcaactccatgcagcaaaataccggcgctaacaacattgtggcaaccacccagaatggctacaaaccgggcgatctggtgagttatcaaatcaatgatgacggtacggttgtcggcaactattccaacgaacaaacccaactgctggggcagattgtactggcgaactttgccaacaacgaaggtctggcatccgaaggcgacaacgtctggtctgcgacgcaatcttctggcgtggcgctgttggggacagccgggacgggcaactttggcaccctgaccaacggtgcgctggaagcgtccaacgtcgatctcagtaaagaactggtcaatatgatcgttgcccagcgtaactatcagtctaacgcccagaccatcaaaacccaggaccagatcctcaacacgctggttaacttacgctaatcgctgacgggatagctcaatggatcacgcaatttataccgcgatgggagcagccagccagacgctgaatcaacaggcggtaaccgccagtaatctggccaatgcctcaacgcccggttttcgcgcgcagttaaacgccttgcgtgcagtgccggtggaagggctttcactgcctacgcgcacgctggtaacggcgtcaacaccgggtgcagacatgacgcccggcaagatggattacacctcgcgcccgctggacgttgcgttgcagcaggatggctggctggccgtgcagaccgctgacggcagcgaagggtatacgcgtaatggcagcattcaggttgatcccaccgggcaactgacaattcaggggcatccggtgataggcgaggcggggccaattgctgtgccggaaggggcggaaatcactattgctgccgatggcacaatctcggcgctcaatccgggcgatccggtaaatacggttgcgccagtggggcgtctgaaactggtgaaagccacgggcagcgaagtgcaacgcggtgacgacggcatttttcgtttaagcgcagaaagccaggccacgcgtgggccgatactgcaggcagatccaaccttgcgtgtgatgtcgggggttctggaaggcagtaacgtcaatgccgttgcggcaatgagcgacatgattgccagcgcgcggcgttttgaaatgcagatgaaggtgatcagcagcgtcgatgataacgcaggccgtgccaaccaactgctgtcgatgagttaattgaaaggatacatgacaagtataagttgcccgatgcgcaagtttatcgggtctatgggggcaatcgcaatttatcgattttgcgagcacttgtaggccggataaggcgtttacgccgcatccggcaagaagacatatgcactttgtcactaatccactacaggacattttatgatcagttcattatggatcgccaaaacgggccttgacgcccagcaaaccaatatggacgtcattgccaacaacctggcaaacgtcagtactaacggttataagcgtcagcgcgcggtgtttgaagatctgctttatcaaaccattcgccagccgggggcacagtcttccgaacaaaccaccttaccctccggattacaaatcggcacgggggtacgcccggtcgccactgaacgcttacacagccagggaaacctgtcgcagaccaacaacagcaaagatgtcgcgattaaagggcagggctttttccaggtgatgttgccagatggctcatcagcctatacccgtgacggctctttccaggtggatcagaacgggcagctggtgacggctggtggttttcaggtacagccagcgatcaccattccggcgaatgcgttaagtatcaccatcggtcgtgatggcgtggtcagcgtaacccaacaaggccaggcagctccggttcaggttgggcagctcaatctcaccacctttatgaatgataccgggctggagagcattggcgaaaacctctacaccgaaacgcaatcctccggtgcaccgaacgaaagcacgccgggcctgaacggcgcgggactgctgtatcaagggtatgttgaaacgtctaacgtcaacgtggcggaagaactggtcaatatgattcaggtgcaacgcgcttacgaaatcaacagtaaagcggtgtccaccaccgatcagatgctgcaaaaactgacgcaactctaaggcttaaccggtggcaggttcaccggtttactgatttttgaagatgatagccatgcaaaaaaacgctgcgcatacttatgccatttccagcttgttggtgctttcactaaccggctgcgcctggataccctccacgccgctggtgcagggggcgaccagtgcacaaccggttcccggtccgacgcccgtcgccaacggttctattttccagtctgctcagccgattaactatggctatcaaccgctgtttgaagatcgtcgaccacgcaatattggcgatacgctgaccatcgtgttgcaggagaacgtcagcgccagcaaaagctcctctgcgaatgccagccgtgacggtaaaactaattttggctttgatactgtgccgcgctatttgcaggggctgtttggtaacgctcgtgccgatgtcgaagcctccggtggtaacacgttcaacggaaagggcggggccaatgccagcaatacctttagcggcacgttgacggtgacggttgaccaggtactggtcaacggcaacctgcatgtggtgggtgaaaaacagattgccattaatcagggtaccgaatttattcgcttctctggcgtggttaatccacgcactatcagcggcagcaataccgtaccgtctactcaggtggcggatgcgcgcattgaatacgtaggcaatggctacattaacgaagcgcaaaatatgggctggttgcagcgtttcttccttaacctgtcgccaatgtaagtgaggctgtggtgattaaatttctctctgcattaattcttctactggtcacgacggcggctcaggctgagcgtattcgcgatctcaccagtgttcagggggtaaggcaaaactcactgattggctatggtctggtggtggggctggatggcaccggtgaccagacaacccagacgccgtttaccacacaaacgcttaataacatgctctcacagctgggaattaccgttccgacgggcaccaatatgcagctaaaaaacgtcgctgcggtaatggtgacagcgtcacttcctccgtttggacgtcaggggcaaaccatcgatgtggtggtttcttccatgggtaatgccaaaagcttgcgtggaggtacgttgttgatgacaccgcttaagggcgttgacagtcaggtgtatgcgctggcgcagggcaatattctggttggcggcgcaggagcctccgctggcggtagcagtgttcaggttaaccaactgaacggtggacggatcaccaatggtgcggttattgaacgtgaattgcccagccagtttggcgtcgggaatacccttaatttgcaacttaacgacgaagatttcagcatggcgcagcaaatcgctgataccatcaaccgcgtgcgtggatatggcagcgccaccgcgttagatgcgcggactattcaggtgcgcgtaccgagtggcaacagttcccaggtccgcttccttgccgatattcagaatatgcatgttaatgtcaccccgcaggacgctaaagtagtgattaactcgcgcaccggttcggtggtgatgaatcgcgaagtgaccctcgacagctgcgcggtagcgcaggggaatctctcagtaacagttaatcgtcaggccaatgtcagccagccagatacaccgtttggtggtggacagactgtggttactccacaaacgcagatcgatttacgccagagcggcggttcgctgcaaagcgtacgttccagcgccagcctcaataacgtggtgcgcgcgctcaatgcgctgggcgctacgccgatggatctgatgtccatactgcaatcaatgcaaagtgcgggatgtctgcgggcaaaactggaaatcatctgatgatcagcgacagcaaactactggcaagtgcggcctgggatgcgcaatcactcaacgaactaaaggcgaaagcgggcgaagatccggcggcaaatatccgtccggtggcccgtcaggtggaagggatgttcgtgcagatgatgttgaaaagcatgcgcgacgctttaccaaaagatggcctgttcagcagcgagcacactcgcctgtataccagtatgtatgaccagcagattgcccaacagatgacggcgggcaaaggtctggggcttgcagagatgatggttaaacagatgacgccagaacaaccattgccagaggagtctacgccagcagcaccgatgaaattcccgctcgaaactgtggtgcgttatcaaaatcaggcgctttcgcagctggtgcaaaaggccgtgccacgtaactacgatgattcgctgccgggtgacagtaaagcattcctcgcgcaactctcgctgcccgcccaactggcaagccagcaaagcggtgtgccacatcatttgatcctcgctcaggcggcactggaatctggttgggggcaacggcaaatccgccgcgaaaacggcgagccgagctataacctgtttggtgtcaaagcctctggcaactggaaagggccagttactgaaatcaccacgactgaatatgaaaacggcgaagcgaagaaagtaaaagcgaagtttcgggtctacagctcgtatctggaagcattgtcggattacgttgggctgttaacacgtaacccgcgctacgccgccgtgacgaccgccgcgagtgcggagcagggggcgcaggccctacaggacgcggggtatgctaccgatcctcactatgcccgtaaactcaccaacatgatccagcagatgaaatcgataagcgacaaggtgagcaaaacctacagcatgaacattgataatctgttctgaataactcaagtccggcgggtcgctgccgataatactctgtaattgaaggcttataaggaacctccatgtccagcttgatcaataacgccatgagcggactgaacgcggcccaggcggcgttaaatacggcaagtaataatatctccagctataacgttgccggatatacccgccaaaccactattatggcgcaggccaatagcacgttgggcgctggcggctgggttggcaatggtgtctacgtttctggtgtgcagcgtgagtatgatgcttttattaccaaccagttacgtgcggcgcagacgcaaagtagcggcctgactgcccgctatgagcagatgtcgaaaatcgacaatatgctctccaccagtacctcttcgctggcaacacagatgcaggatttcttcaccagcctgcaaacgctggtgagtaacgcggaagacccggcagcgcgccaggcgctgattgggaaatcagaagggttggtgaatcagtttaaaaccaccgatcaatatctgcgcgaccaggacaaacaggtcaatatcgcgataggtgccagcgttgatcagatcaacaattacgctaaacaaattgccagcctgaacgatcaaatctcgcgcctgacaggcgtgggggcaggggcctcacctaacaatctgctggatcaacgcgatcaactggtgagcgaattaaaccagattgttggcgtagaagtcagcgttcaggatggcggtacttataacatcacgatggccaatggttactcactggttcagggaagtacggcgcggcaactggcggcagttccttccagcgccgacccttctcgtacgactgtcgcttacgttgatgggacggcaggcaatattgagatcccggagaaattactgaataccgggtcgctgggcggcattctgacattccgttctcaggatctggaccagacgcgtaatacgcttggacaactggcgctggcatttgccgaggctttcaacagccaacacaaagccggatttgatgccaacggcgatgagggtgaagatttctttgctatcggtaagcccgcggttctgcaaaacactaaaaacaacggtaacgttgcgatcggtgccacggtaactgatgcctccgtggtactggcgacagattacaaaatctcgttcgataataatcagtggcaggtcacccgccttgccagcaataccacttttacggtgacaccagatgccaacggtaaagtggcatttgatggtctggagttgacgtttacaggaacgcctgccgttaacgacagcttcacgctgaaaccagtaagtgacgccatcgtcaacatggatgtattaatcaccgacgaagcgaaaatcgcgatggcgagcgaagaagatgcgggtgatagcgacaaccgcaacggtcaggccctgctggatctgcaaagcaacagtaaaacggtgggcggagcgaaatcctttaacgacgcttatgcctcgttagtgagtgatatcggtaataaaaccgcgacgttgaaaaccagtagcaccacgcaaggtaatgtggtgacgcagctttccaatcagcagcagtcgatttccggtgtcaatctcgatgaggagtacggaaatctgcaacgttttcagcagtattacctggcgaatgcgcaggttctgcagacggcaaacgcgatttttgatgcgctgattaacattcgctaaggggagataaaatgcgtttcagtacccagatgatgtaccagcaaaacatgcgcggcatcaccaattctcaggcagaatggatgaagtacggcgagcagatgtcgacgggtaagcgagtcgttaacccttctgacgatcccattgcagcatcacaagcggtagttctctcccaggcacaggcgcaaaacagccagtacacgctggcgcgaactttcgccactcaaaaagtgtcactggaagagagtgtacttagccaggtcaccactgctatccagaatgctcaggaaaaaattgtctatgccagcaatggcactttgagtgacgatgaccgggcctcgctggctacggatattcaggggcttcgtgaccagttgctgaatctggcgaacaccactgacggtaacgggcgctacatttttgccggttataaaacagagactgcgccgtttagcgaagagaaagggaaatacgtcggtggagcagaaagtattaaacaacaggtcgatgcttcgcgttcgatggtgatagggcacacgggtgacaaaattttcgacagtattaccagcaacgcggtagcggaaccagacggtagcgcttctgaaaccaatctttttgccatgctggatagtgccatcgcagccctgaaaacgccggtcgcggatagcgaagcggataaagaaaccgccgctgcggcgttagataaaaccaaccgcggactgaaaaactcgctgaacaatgtgctgactgttcgcgcggaattaggcacgcagctgaacgaactggagtcgctggattcattaggtagcgatcgcgctttagggcaaacgcagcagatgagcgatctggttgatgtggactggaatgcaactatttcatcttacatcatgcagcaaacggcattgcaggcatcgtataaagcatttaccgatatgcagggattgtcgctcttccagctcaacaaataatttcgctttaaaacatatcatgaaactgggtatgttttgtctgcctgctctgggatcgctggggcgggcatttttttgcctattttgcattgttggttagcaaggatgccattcgatgaattttaatatgttgattcaaagatgaaataaaaaagccctggcagttaccagggcttgattactttgagctaattattactcgacaggttgcggacgcgcaggagcggcagaggcatgatgtgttgccgtatgaccacctgcggcacctttaccttcgaaggcaaaagtagggcgctgccagtcactgtgacgcggtgcctccggaacatattccggtgccggagcgcgcgtcattggcgcggtagcgtggttatgctcaacggtgacctcaggttcgaccgcagctaccgtttcaacttctgctgcgacttcagcgactactggcgcggcaggttgagcaacaacttcaggttcagcaactacaacctcagcagtttcgacaacttcttcaatatctgccgtctcttcctgcggttcaaccaccggttctgcttgttctgcaacttcctgggctacggcaacatcagactcggtaatcacctgcggctgttcagttaccgcggcagcaatcacttcaggatgcgtcgtttcaaccacttccggttgcggttcggcaacctgaacgggggcttctacgaaaccggccacttcttcaacaactggcgcgctaacaaccggttcgatagcggcggcgacagggacctcagtcaccatcggctgcacatgtacttcttcctgttcgcgctgctcttcaacctgtacatcttgtggacgtacaattggatagcggatccagactttgccagaggccagttccggagacgcgcacgctacggtcaacggcattggcgactgggttggataacgctcgtcacgatagcgacgacgacgctgaccactcacgcgcaggtgacgaggcgagcggcgagaacgacgcggcatgccaccgttgtcacggttatcagcattgttctcttcttgctgttctggtgcagtttgcgctacgactggcagcgggactttcaccagttctgtgcgtggagctggagcttcctgaacaattggttcggcagcggcagtttcttcaaccaccggtgcgactaccgcttcttcggctacgctttgctcgtaacgcactttctgattgagctgacgctgtttacgacgcggctgaaccggacgtacacgttcttcctgttcggtttcctgaacagattgctcttcaacattcagcgccttcgcttcttgttgcgcctgacgtttatcatcgttacggcggcggctacgttcacgacgcggcgcttgctgctcgtcggtggtacgtgctttttccgttacctcagcttgctgacggctctcacgcgtctcggcagtctgctgctgtgcctggcgacgattacgacggttttcttcgcgattatcgctgccttcagtacgttcgctacgggtgtcgcggcgctcattacggtcacggcggttgttctgacgaggcttgcgacgatcctgttgacgttccggtttcgcttctgctttcggtgttggttgctcggtcggtttggcttcttcaccaccgctgaacagcgctttcagtgcgccgaagaagcggcttaatagcccaggttgtgcaggagctgctggtgttgccgttgcagctttcggtgctggggctacgacagtcgcggcaggttcagctggggttggcgctggcggcacatccggcatggcaaaggttgccagtgcaggttgttcaggacgcttacgttcagcgaactcttcttcagacggcagcgccatcgcttcttcatgcagtttcggcagcatgtagcttaaggtcggcgtttcttcccctttgcgcacgcgcaacacgtggtagtgcggggtttccatctgatcgtttggcacaatcacgcagcgaacaccgtcctgacgcgtttcaatcgcattcaccgcagaacgtttttcattcagcaggtaagaagcgattggcacaggaacaatggcgtgaacttcctgggtgttctctttcagcgcttcttcttcgatcagacgcagaatagagagcgacagcgattcgttgtcacgcacggtgccagtaccagaacaacgcggacaaacgtgatgactggattcacccagtgatgggctcaggcgctgacgggacatttccagcaggccaaagcgagaaatatggctgatttgaatacgcgcacggtcctgacgcaccgcttcacgcagacggttttctaccgcacgctggtggcgtacaggcgtcatgtcgatgaagtcgataacaatcaggccgccgaggtcacgcaggcgcagctgacgagcaatctcatcggcagcttcgaggttggtgttaaacgcggtttcttcgatatcgccgccgcgggtcgcgcgtgcggagttgatgtcgatggcagttaacgcttcggtactgtcgataacaatcgaaccaccggatggcagacggacttcacgctggaaggcggactcgatctgcgactcgatctggtagtggctgaacagcgggatctcgccggtgtacagtttgattttgctgctgaaatccgggcgacctaatgcagcgatatgctgacgtgccagttcgagcactttcgggttatcgataaggatttcgccgatgtcctggcgtaagtaatcgcggaaagcgcgaacgattacgttgctctcctgatgaatcaggaacggggccgggcggctttcagcggcttttttgatggcttcccagtgtttcagacggaagcttaaatcccattgcagtgcctcagcagatttgccgacgccagcggtgcgcacgataagccccatgccttccggcagttcaaggcttgccagtgcttcttttaattcggtacggtcgtcgccttcgatacggcgagaaatgccacccgcgcgcgggttgttcggcatcagaaccagatagctacccgccagactgataaaggtggttaatgccgcgcctttgttgccgcgctcttctttatcgatctgaacaatgacttcctgaccttcacgcaacacatctttaatgttgggacgaccatgagcactgtagttagcagggaaatattcgcgggcaatttcttttagtgggaggaaaccgtgacgttcagcgccgtaatcaacaaaagcagcttccagactcggttcaatgcgggtgattttacctttgtagatgtttgcctttttctgctcgtgccctggactttcgatatccaggtcatacagacgctgcccatctacaagggcaacgcgcaactcttcctgctgagttgcgttgattaacattcttttcatcgtaacttactcattattcttacattgacgactaagctgcgggcaaagtaacgcctttccgggtgtgaaccgatggcctcgtgtctagtcgcgtcgccaacctcacggttatcgtcagctcaaagaggcgcagagtgtcggttgcccgtttttcatgcggaaaaacagcgcaattatcaaagaaacagactgggtattactctccagaaatatttccatctaccggtaaggactgcaacccgcagcccgctaactgcctgaaagatcaatacgtcttacgccattgctgcgtggatgatcggtcgggcaaaatgggttattccgtaaaatttcttgttttaacaaggatggacacggaaacggcctcattattccactgcaagccttgttatagcaagatgacttttaccatttatcacccgcttactcacagttttttcacttcttgctggtgattggtttaataaccatcaataaagtgatcacgcagtgaagtaataaggtgcaaaagtaaatataagcatagaaaaatgagtggcgcgaatcctgttggctaattagaatcgccaaccatgaaaacagagactccatccgtaaaaattgttgctatcaccgctgacgaagcggggcaacgtatcgataactttttgcgtacccaattgaaaggcgtaccaaaaagtatgatttaccgtattttgcgtaaaggcgaagtgcgggtgaacaaaaaacgtattaagcctgaatataaactcgaagcgggtgatgaggtgcgtattccaccggttcgcgttgctgagcgggaagaagaggcggtttcgccacatctgcaaaaggtggcggcgctggcggacgtcatcttatatgaagatgatcacatcctggtgctgaataaaccttccggtacggcggtacatggcggcagtggtttaagcttcggcgttattgaaggtttgcgggcgttgcgcccggaagcgcggttccttgaactggttcatcgtcttgaccgggacacctcaggtgttttgctggtagcgaaaaaacgctcggcgttgcgttctctgcatgagcaattacgtgaaaaagggatgcaaaaagattacctggcgctggtgcgcggtcagtggcagtcgcatgtgaagagcgttcaagcgccgttattgaaaaatattctgcaaagcggcgaacgtatcgtgcgtgtcagtcaggaaggcaaaccgtcggaaacacgctttaaagtggaagaacgctatgcatttgccaccctggtgcgttgtagcccggtaaccggacgtactcatcagatccgtgtgcatacacagtatgcgggtcatccgattgcctttgacgatcgctacggtgaccgtgaatttgacagacagctcactgaagcaggcacgggattaaatcgtctgttcctgcacgccgcagcgttgaagtttacccatccggggaccggtgaggtgatgcgtatcgaagcgccgatggatgaaggtttgaagcgttgtttgcaaaagctgcgtaacgcgcgctaatacaagcatataagcctgataatgggcggttggcctgataaggcgtttacgccgcatcaggccgcctgcaccgattgccggatgcgacgtaaccgcatccggcgcaaacaactatcccatcagcgggtttttcccttcccgacgtaacatctgacacagcgcgattagcggtaaaccaaccagcgtgttagggtcacgtccctctaaacgctcaaacagcgtaatgccaaatccttcactcttaaagctacccgcgcagtgcaggggatgctccttacgcacgtaattatcaatctccgcctcgctcaggtgacggaaatggacgtcaaaaggctccacttctgtttgcagatgcccattcgccgaattaaacaacgccagtccagtatagaaggtgacgatattgccgctggctttgcgtaattgcagacgggcattttcttccgttaacggtttaccggtgatttcgccatcaagaacacatacctggtctgaaccaataattaaatgatccggataacgtgacgccagagattgcgctttttcttgtgccagtcgaagcaccaactgtcgcggtgattcgtcgctgcgtggggtttcgtcgacctctggtgctgcacattcaaaagagatttgcagtttttccagaagagcgcgacgccatggcgaggtggaggctaaaataagtttaggcatatttttttccatcagatatagcgtattgatgatagccattttaaactatgcgcttcgttttgcaggttgatgttcgttatcagcactgaacgaaaataaagcagtaacccgcaatgtgtgcgaattattggcaaaaggcaaccacaggctgcctttttctttgactctatgacgttacaaagttaatatgcgcgccctatgcaaaaggtaaaattacccctgactctcgatccggttcgtacggctcaaaaacgccttgattaccagggtatctatacccctgatcaggttgagcgcgtcgccgaatccgtagtcagtgtggacagtgatgtggaatgctccatgtcgttcgctatcgataaccaacgtctcgcagtgttaaacggcgatgcgaaggtgacggtaacgctcgagtgtcagcgttgcgggaagccgtttactcatcaggtctacacaacgtattgttttagtcctgtgcgttcagacgaacaggctgaagcactgccggaagcgtatgaaccgattgaggttaacgaattcggtgaaatcgatctgcttgcaatggttgaagatgaaatcatcctcgccttgccggtagttccggtgcatgattctgaacactgtgaagtgtccgaagcggacatggtctttggtgaactgcctgaagaagtgcaaaagccaaacccatttgccgtattagccagcttaaagcgtaagtaattggtgctccccgttggatcggggataaaccgtaattgaggagtaaggtccatggccgtacaacagaataaaccaacccgttccaaacgtggcatgcgtcgttcccatgacgcgctgaccgcagtcaccagcctgtctgtagacaaaacttctggtgaaaaacacctgcgtcaccacatcactgccgacggttactaccgcggccgcaaggtcatcgctaagtaatcacgcgtctgcgtgatgaagcttagtgaggattttccccaggcaactggggaaagaccaaaccgggcggcgacgataccttgacacgtctaaccctggcgttagatgtcatgggaggggattttggcccttccgtgacagtgcctgcagcattgcaggcactgaattctaattcgcaactcactcttcttttagtcggcaatcccgacgccatcacgccattacttgctaaagctgactttgaacaacgttcgcgtctgcagattattcctgcgcagtcagttatcgccagtgatgcccggccttcgcaagctatccgcgccagtcgtgggagttcaatgcgcgtggccctggagctggtgaaagaaggtcgagcgcaagcctgtgtcagtgccggtaataccggggcactgatggggctggcaaaattattactcaagcccctggaggggattgagcgtccggcgctggtgacggtattaccacatcagcaaaagggcaaaacggtggtccttgacttaggggccaacgtcgattgtgacagtacaatgttggtgcaatttgccattatgggctcagttctggctgaagaggtggtggaaattcccaatcctcgcgtggcgttgctcaatattggtgaagaagaagtaaagggtctcgacagtattcgggatgcctcagcggtgcttaaaacaatcccttctatcaattatatcggctatcttgaagccaatgagttgttaactggcaagacagatgtgctggtttgtgacggctttacaggaaatgtcacattaaagacgatggaaggtgttgtcaggatgttcctttctctgctgaaatctcagggtgaagggaaaaaacggtcgtggtggctactgttattaaagcgttggctacaaaagagcctgacgaggcgattcagtcacctcaaccccgaccagtataacggcgcctgtctgttaggattgcgcggcacggtgataaaaagtcatggtgcagccaatcagcgagcttttgcggtcgcgattgaacaggcagtgcaggcggtgcagcgacaagttcctcagcgaattgccgctcgcctggaatctgtatacccagctggttttgagctgctggacggtggcaaaagcggaactctgcggtagcaggacgctgccagcgaactcgcagtttgcaagtgacggtatataaccgaaaagtgactgagcgtacatgtatacgaagattattggtactggcagctatctgcccgaacaagtgcggacaaacgccgatttggaaaaaatggtggacacctctgacgagtggattgtcactcgtaccggtatccgcgaacgccacattgccgcgcaaaacgaaaccgtttcaaccatgggctttgaagcggcgacacgcgcaattgagatggcgggcattgagaaagaccagattggcctgatcgttgtggcaacgacttctgctacgcacgctttcccgagcgcagcttgtcagattcaaagcatgctgggcattaaaggttgcccggcatttgacgttgcagcagcctgcgcaggtttcacctatgcattaagcgtagccgatcaatacgtgaaatctggggcggtgaagtatgctctggtcgtcggttccgatgtactggcgcgcacctgcgatccaaccgatcgtgggactattattatttttggcgatggcgcgggcgctgcggtgctggctgcctctgaagagccgggaatcatctccacccatctgcatgccgacggtagctatggtgagttgctgacgctgcctaatgctgaccgtgtgaatccagagaattcaattcatctgacgatggcgggcaacgaagtcttcaaggttgcggtaacggaactggcgcacatcgttgatgagacgctggcggcaaataatcttgaccgttctcaactggactggctggttccgcatcaggctaacctgcgtattatcagtgcaacggcgaaaaaactcggtatgtctatggacaatgtcgtggtgacgctggatcgccacggtaatacctctgcggcctctgtcccgtgcgcgctggatgaagctgtacgcgacgggcgcattaagccggggcagttggttctgcttgaagcctttggcggtggattcacctggggctccgcgctggttcgtttctaggataaggattaaaacatgacgcaatttgcatttgtgttccctggacagggttctcaaaccgttggaatgctggctgatatggcggcgagctatccaattgtcgaagaaacgtttgctgaagcttctgcggcgctgggctacgacctgtgggcgctgacccagcaggggccagctgaagaactgaataaaacctggcaaacccagccagcgctgttgactgcatctgttgcgctgtaccgcgtatggcagcagcagggcggtaaagcaccggcaatgatggccggtcacagcctgggggaatactccgcgctggtttgcgctggtgtgattgatttcgctgatgcggtgcgtctggttgagatgcgcggcaagttcatgcaagaagccgtaccggaaggcacgggcgctatggcggcaatcatcggtctggatgatgcgtctattgcgaaagcgtgtgaagaagctgcagaaggtcaggtcgtttctccggtaaactttaactctccgggacaggtggttattgccggtcataaagaagcggttgagcgtgctggcgctgcctgtaaagctgcgggcgcaaaacgcgctctgccgttaccagtgagcgtaccgtctcactgtgcgctgatgaaaccagcagccgacaaactggcagtagaattagcgaaaatcacctttaacgcaccaacagttcctgttgtgaataacgttgatgtgaaatgcgaaaccaatggtgatgccatccgtgacgcactggtacgtcagttgtataacccggttcagtggacgaagtctgttgagtacatggcagcgcaaggcgtagaacatctctatgaagtcggcccgggcaaagtgcttactggcctgacgaaacgcattgtcgacaccctgaccgcctcggcgctgaacgaaccttcagcgatggcagcggcgctcgagctttaaaagaggaaaatcatgaattttgaaggaaaaatcgcactggtaaccggtgcaagccgcggaattggccgcgcaattgctgaaacgctcgcagcccgtggcgcgaaagttattggcactgcgaccagtgaaaatggcgctcaggcgatcagtgattatttaggtgctaacggcaaaggtctgatgttgaatgtgaccgacccggcatctatcgaatctgttctggaaaaaattcgcgcggaatttggtgaagtggatatcctggtcaataatgccggtatcactcgtgataacctgttaatgcgaatgaaagatgaagagtggaacgatattatcgaaaccaacctttcatctgttttccgtctgtcaaaagcggtaatgcgcgctatgatgaaaaagcgtcatggtcgtattatcactatcggttctgtggttggtaccatgggaaatggcggtcaggccaactacgctgcggcgaaagcgggcttgatcggcttcagtaaatcactggcgcgcgaagttgcgtcacgcggtattactgtaaacgttgttgctccgggctttattgaaacggacatgacacgtgcgctgagcgatgaccagcgtgcgggtatcctggcgcaggttcctgcgggtcgcctcggcggcgcacaggaaatcgccaacgcggttgcattcctggcatccgacgaagcagcttacatcacgggtgaaactttgcatgtgaacggcgggatgtacatggtctgaccgcgatttgcacaaaatgctcatgttgcgcgcagtctgcgtggttatgagtaataattagtgcaaaatgatttgcgttattggggggtaaggcctcaaaataacgtaaaatcgtggtaagacctgccgggatttagttgcaaatttttcaacattttatacactacgaaaaccatcgcgaaagcgagttttgataggaaatttaagagtatgagcactatcgaagaacgcgttaagaaaattatcggcgaacagctgggcgttaagcaggaagaagttaccaacaatgcttctttcgttgaagacctgggcgcggattctcttgacaccgttgagctggtaatggctctggaagaagagtttgatactgagattccggacgaagaagctgagaaaatcaccaccgttcaggctgccattgattacatcaacggccaccaggcgtaagtgaacatctccaggcggtcgttcgaccgcctgagttttatctttttgtcccactagaatcattttttccctccctggaggacaaacgtgtctaagcgtcgtgtagttgtgaccggactgggcatgttgtctcctgtcggcaataccgtagagtctacctggaaagctctgcttgccggtcagagtggcatcagcctaatcgaccatttcgatactagcgcctatgcaacgaaatttgctggcttagtaaaggattttaactgtgaggacattatctcgcgcaaagaacagcgcaagatggatgccttcattcaatatggaattgtcgctggcgttcaggccatgcaggattctggccttgaaataacggaagagaacgcaacccgcattggtgccgcaattggctccgggattggcggcctcggactgatcgaagaaaaccacacatctctgatgaacggtggtccacgtaagatcagcccattcttcgttccgtcaacgattgtgaacatggtggcaggtcatctgactatcatgtatggcctgcgtggcccaagcatctctatcgcgaccgcctgtacttccggcgtgcacaacattggccatgctgcgcgtattatcgcgtatggcgatgctgacgtgatggttgcaggtggcgcagagaaagccagtacgccgctgggtgttggtggttttggcgcggcacgtgcattatctacccgcaatgataacccgcaagcggcgagccgcccgtgggataaagagcgtgatggcttcgtactgggcgatggtgccggtatgctggtacttgaagagtacgaacacgcgaaaaaacgcggtgcgaaaatttacgctgaactcgtcggctttggtatgagcagcgatgcttatcatatgacgtcaccgccagaaaatggcgcaggcgcagctctggcaatggcaaatgctctgcgtgatgcaggcattgaagcgagtcagattggctacgttaacgcgcacggtacttctacgccggctggcgataaagctgaagcgcaggcggtgaaagccatcttcggtgaagctgcaagccgtgtgttggtaagctccacgaaatctatgaccggtcacctgttaggtgcggcgggggcagtagagtctatctactccatcctggcgctgcgcgatcaggctgttccgccaaccatcaacctggataacccggatgaaggttgcgatctggatttcgtaccgcatgaagcacgtcaggtcagcggaatggaatacacgctgtgtaactccttcggcttcggtggcactaatggttctttgatctttaaaaagatctaagttgtcatttcccacccatataaaaggtccgcttgcgggccttttttcttagcttttattccgacttgttccgtagtgaacatgctgccacactaacaattctctgataaggagccggtatgttcttaattaacggttataagcaggaatcgctggcagtaagcgatcgggcaacgcagtttggtgatggttgttttaccactgccagagttatcgacggtaaagtcagtttgttatcggcgcatatccagcgactacaggatgcttgtcagcggttgatgatttcctgtgacttctggcctcagcttgaacaagagatgaaaacgctggcagcagaacagcaaaatggtgtactgaaagtcgtgatcagtcgcggtagtggcgggcgagggtacagcacattgaacagcggaccagcaacgcggattctctccgttacggcttatcctgcacattacgaccgtttgcgtaacgaggggatgacgttggtgctaagcccggtgcggctggggcgcaatcctcatcttgcaggtattaaacatcttaatcggcttgagcaagtattgattcgctctcatcttgagcagacaaacgctgatgaggcgctggtccttgacagcgaagggtgggttacggaatgctgtgcggctaatttgttctggcggaagggcaacgtagtttatacgccgcgactggatcaggcaggtgttaacggcattatgcgacaattctgtatccgtttgctggcacaatcctcttatcagcttgtcgaagtgcaagcttctctggaagaggcgttgcaggcagatgagatggttatttgtaatgcgttaatgccagtgatgcccgtacgtgcctgtggcgatgtctccttttcgtcagcaacgttatatgaatatttagccccactttgtgagcgcccgaattagtcatgaaaaaagtgttattgataatcttgttattgctggtggtactgggtatcgccgctggtgtgggcgtctggaaggttcgccatcttgccgacagcaaattgcttatcaaagaagagacgatatttaccctgaagccagggaccggacgtctggcgctcggtgaacagctttatgctgataagatcatcaatcgcccacgggtttttcaatggctgctgcgtatcgaaccggatctttctcactttaaagccgggacttaccgctttacaccgcagatgaccgtgcgcgagatgctgaaattgttggaaagcggtaaagaagcacagttcccgctgcgactggtagaagggatgcgtctgagcgactacctcaagcaattgcgtgaggctccgtatatcaagcacacgctgagtgacgataagtacgccaccgtagcgcaggcacttgaactggaaaacccggagtggattgaaggttggttctggccagacacctggatgtataccgccaataccaccgatgtcgcgttactcaagcgagcgcacaagaaaatggtgaaagcggtcgatagcgcctgggaagggcgtgcggacggtctgccttataaagataaaaatcagctggtgacgatggcatcaattatcgaaaaagaaaccgccgttgccagtgaacgcgatcaggttgcctcggtatttatcaaccgtttacgcattggtatgcgcttgcagaccgacccaaccgtgatttacgggatgggagagcgttataatggcaaactttctcgtgcagacctggaaacgccgacagcgtataacacctataccattaccggtttgccgccgggtgcgatagctacgccgggggcggattcgctgaaggctgctgcgcatccggcaaaaacgccgtatctctattttgtggccgatggtaaaggtggtcacacgtttaataccaatcttgccagtcataacaagtctgtgcaggattatctgaaagtgcttaaggaaaaaaatgcgcagtaagtatatcgtcattgaggggctggaaggcgcaggcaaaactaccgcgcgtaatgtggtggttgagacgctcgagcaactgggtatccgcgacatggttttcactcgggaacctggcggtacgcaacttgccgaaaagttaagaagcctggtgctggatatcaaatcggtaggcgatgaagtcattaccgataaagccgaagttctgatgttttatgccgcgcgcgttcaactggtagaaacagtcatcaaacctgcgctggctaacggcacctgggtgattggcgatcgccacgatctctccactcaggcgtatcagggcggcggacgtggtattgaccaacatatgctggcaacactgcgtgatgctgttctcggtgattttcgccccgacttaacgctctatctcgatgttaccccggaagttggcttaaaacgcgcgcgtgcgcgcggcgagctggatcgtattgagcaagagtctttcgatttctttaatcgcacccgcgcccgctatctggaactggcagcacaagataaaagcattcataccattgatgccacccagccgctggaggccgtgatggatgcaatccgcactaccgtgacccactgggtgaaggagttggacgcatgagatggtatccatggttacgacctgatttcgaaaaactggtagccagctatcaggccggaagaggtcaccatgcgctgctcattcaggcgttaccgggcatgggcgatgatgctttaatctacgccctgagccgttatttactctgccaacaaccgcagggtcacaaaagttgcggtcactgtcgtggatgtcagttgatgcaggctggcacgcatcccgattactacaccctggctcccgaaaaagggaaaaatgcgttgggcattgatgcggtacgtgaggtcaccgaaaagctgaatgagcacgcacgcttaggtggtgcgaaagttgtctgggtaaccgatgctgccttactaaccgacgccgcggctaacgcattgctgaaaacgcttgaagagccaccagcagaaacctggtttttcctggctacccgcgagcctgaacgtttactggcaacattacgtagtcgttgtcggttacattaccttgcgccgccgccggaacagtacgccgtgacctggctttcacgcgaagtgacaatgtcacaggatgcattacttgccgcattgcgcttaagcgccggttcgcctggcgcggcactggcgttgtttcagggagataactggcaggctcgtgaaacattgtgtcaggcgttggcatatagcgtaccatcgggcgactggtattcgctgctggcggcccttaatcatgaacaagctccggcgcgtttacactggctggcaacgttgctgatggatgcgctaaaacgccatcatggcgctgcgcaggtgaccaatgttgatgtgccgggcctggtcgccgaactggcaaaccatctttctccctcgcgcctgcaggctatactgggggatgtttgccacattcgtgaacagttaatgtctgtcacaggcatcaaccgcgagcttctcatcaccgatcttttactgcgtattgagcattacctgcaaccgggcgttgtgctaccggttcctcatctttaagagagacatcatgtttttagtcgactcacactgccatctcgatggtctggattatgaatctttgcataaggacgtggatgacgttctggcgaaagccgccgcacgcgatgtgaaattttgtctggcagtcgccacaacattaccgggttatttacatatgcgggagctggtaggcgaacgtgacaacgtcgtattttcttgtggcgtgcatccactcaaccagaatgatccctacgatgtagaagatttacgccgtctggcggcagaagagggtgttgtagcgctgggagaaaccgggctggattattattacacaccggaaactaaagttcgtcagcaagagtccttcatccatcatatccagattggtcgtgaactgaacaagccggttatcgtccatacccgtgacgcccgcgccgatacgctggcaattctgcgcgaagaaaaagtgacggattgcggtggcgtactacactgttttacagaggacagagaaacggcgggcaaattactggatctcggattttacatctccttttccggcattgtgaccttccgtaatgcggagcaactgcgcgatgctgcgcgttatgtccccctggatcggttactggtggaaactgactcaccttaccttgcgccggtaccgcatcgaggaaaagagaatcaacctgcgatggttcgtgacgttgcagaatacatggctgtgttgaaaggtgttgccgttgaagaactggcgcaggtaaccaccgataacttcgcccgtctgtttcacatcgacgcttcccgccttcaatccatccgttgaatgagtttttttaaagctcgtaattaatggctaaaacgagtaaagttcaccgccgaaaatttggcggtgaataaccacgtttgaaatattgtgacatatgttttgtcaaaatgtgcaacttctccaatgatctgaagttgaaacgtgatagtcgtcaaacaaattggcactgaattattttactctgtgtaataaataaagggcgcttagatgccctgtacacggcgaggatctccccccttgccacgcgtgagaacgtaaaaaaagcacccatactcaggagcactctcaattatgtttaagaatgcatttgctaacctgcaaaaggtcggtaaatcgctgatgctgccggtatccgtactgcctatcgcaggtattctgctgggcgtcggttccgcgaatttcagctggctgcccgccgttgtatcgcatgttatggcagaagcaggcggttccgtctttgcaaacatgccactgatttttgcgatcggtgtcgccctcggctttaccaataacgatggcgtatccgcgctggccgcagttgttgcctatggcatcatggttaaaaccatggccgtggttgcgccactggtactgcatttacctgctgaagaaatcgcctctaaacacctggcggatactggcgtactcggagggattatctccggtgcgatcgcagcgtacatgtttaaccgtttctaccgtattaagctgcctgagtatcttggcttctttgccggtaaacgctttgtgccgatcatttctggcctggctgccatctttactggcgttgtgctgtccttcatttggccgccgattggttctgcaatccagaccttctctcagtgggctgcttaccagaacccggtagttgcgtttggcatttacggtttcatcgaacgttgcctggtaccgtttggtctgcaccacatctggaacgtacctttccagatgcagattggtgaatacaccaacgcagcaggtcaggttttccacggcgacattccgcgttatatggcgggtgacccgactgcgggtaaactgtctggtggcttcctgttcaaaatgtacggtctgccagctgccgcaattgctatctggcactctgctaaaccagaaaaccgcgcgaaagtgggcggtattatgatctccgcggcgctgacctcgttcctgaccggtatcaccgagccgatcgagttctccttcatgttcgttgcgccgatcctgtacatcatccacgcgattctggcaggcctggcattcccaatctgtattcttctggggatgcgtgacggtacgtcgttctcgcacggtctgatcgacttcatcgttctgtctggtaacagcagcaaactgtggctgttcccgatcgtcggtatcggttatgcgattgtttactacaccatcttccgcgtgctgattaaagcactggatctgaaaacgccgggtcgtgaagacgcgactgaagatgcaaaagcgacaggtaccagcgaaatggcaccggctctggttgctgcatttggtggtaaagaaaacattactaacctcgacgcatgtattacccgtctgcgcgtcagcgttgctgatgtgtctaaagtggatcaggccggcctgaagaaactgggcgcagcgggcgtagtggttgctggttctggtgttcaggcgattttcggtactaaatccgacaacctgaaaaccgagatggatgagtacatccgtaaccactaatctgtaagacgttggggagactaaggcagccagatggctgccttttttacaggtgttattcagaattgatacgtgccggtaatgctgaaattacgcggtgcgccgtagacgatagaaccttccacgttggtatcgtaggttttgtcgaacaggttattgacgttcccctgtaacgagaagtttttcgtcacctggtagcgggtgaagagatccaccagcgcgtagctaccttgctcggcgcggaaggtgccatacggtgtcacggtgtcggtatacacgcgattttgccagttaacaccaccgccgactgtcaactctggcatgacaggcaaccgatagctggtgaacattttaaccgtggtgcgtggcagattaggattaacggcgtttccttcgttatcctctgcaatatagcgcgttgcgccaaatgtcagctgccagttgtcggtaattgcgccgttgagttcaaattccacccctttactgactgtcccatccaccgctttataggcggtttcgccgttgctgccggggataggtgtaccggtggactgagcgacattatcctgctcaatacggaagatggctaacgtggtggtcagacggctattcatccagtccgatttcagacccagctcgtagttgttaccggtgattggagccagatatttgcctgaactgtcacgatcattttgcggctggaaaatagaggtatagctggcgtaggtcgaccagttgtcattgatgtcaaacaccagaccagcgtaaggcgtggtgtggtttttctccatgctgtaagtcagcgtatcaacccgccagttggtataacgtgcgccgaggatcagatgcagcggatcggcaagggtgactcgagtggcagcatataacgatttcatatgtgtggtatcgtcctgtgccaggctctgtggtgaccagtcggtttgtgggaaattgccattaaagttgtagaaactgccaatttcatccgggaagatgttggcccatgaactgaagtaacgattgttttgtttgctgtaactgccaccaaacattagattgtgctgacgaccaaacaattcataaataccgtcagcgaacaaatccagcgcatcaactttacgtttgccactgttccaaccggtgccgccgacataatcaaagccaggtccataattactgtatggcccaaccagcataccatccgctttgtttacataggcatcgacatacatcattttgctgtcaaattcgacttcagagtgggtggcattcagtgtcgcttgccaggtatcagcaaaccgctgcttcagggtcataaagaccttgttgatctctttatcgttgtacgcccagtcaggtgcggtactgcgtgcacgatcgtaactgttgctgctgccatcagtattccagcgcggtaaaccgccccaggtagggctattaacatcaatgcgctgatattcgtaaccggctgaaagcgtcgtaagatcgcctaaatcagcatcgacaatgcccgagaagaaggtcttttcactgttgtagcggtccagccatgagtcgttattctggtagccgccgacaattcgcgcgcggattttaccgtcttcggtgagtgggctttgtaaatccgccacataccgttctttgttccagctaccgtattccgccgagacatcgcctttaaattcacgactggtcgcgtgttttcgaaccatattaattgccgcagatggattacccgtcccggtcatgagtcctgtcgcgccacgcactacttctacgcgttcaaagagtgccatatcagaaagtgcgtcgcccagattccagcgcgattcaaaataggtggggataccatcaaccatatagttatcgatctggaatccgcgggaataataaagagcacgatcggaatccgcctgacttttgctgatccccagcgtgttttccatcacttcgcccagcgtttgtaactgctgatcttccatccgctgctggctaacaatagtgaccgactgaggaatatcacgttgagtcatctgcattttggtacccgcagaggtagacgttacgctgtaatcattttcgccatcatctggagctgtggctgaaccctcaacaatcaccgtttcttcagtggctggtgcagcaaaagcggcagaaggtaatagtgccagtgctatgcaaccggcaagtagtgacggtttggtgatggcttgatattgattatccctgttaaattgtgttgaaagcatttgaaatctcttggtttatgttgtcgtcaggctcatgccggaggagggtgatgagcggttatatttagtgtgcgaataattttgtttgtaaatgcaaatgagaaatatacgcattcatatttgtcgtgtaaaccaaacagagaatgtcttttcagcgcattcgcaggcagaaatgggaataatggcgatatatacggcagcaaaacgattttttgcttaagaaatcgtgagttaaggttgaaagagcaggtttaactcgaccatactctatactcgcagtgtggcgcggcgtagcatggcgcaacgcatggctatttgaaaaaggaaaatgtcgtggcagaagaaactatattcagcaaaattattcgtcgtgagatcccctccgatatcgtctaccaggatgatctggtaacggcgtttcgcgatatttcgccgcaagcgccaacgcatattctgatcattccgaatatcctcataccgactgtgaacgacgtgtcagctgagcatgagcaggcgctgggacgcatgatcaccgtagcggcaaaaattgctgagcaagaaggtattgccgaagatggctatcgtctgatcatgaacaccaaccgccatggcggacaagaggtttaccacatccatatgcacttgttgggtggccgtccgctgggaccaatgctggcgcataaaggtctgtaacgatgagaaaaggatgctttgggctggtgtctctggcgttgttactgctggtgggctgtcgttcacatccggaaattccggtgaatgatgagcaatcgctggtgatggagtcatctttattggctgcgggcatcagtgcagaaaagcccgtcctttcgacgtctgatattcaaccttcagcatcctcaacgctttataacgaaaggcaagaacccattaccgttcattatcgtttttactggtatgacgccagagggctggagatgcatcctctggaaaggccacgcagcgttaccattcccgcacattcggcggtaacgctgtacggcagcgccaattttctgggggcgcacaaagtcagactttatctatatttgtaaggggtgaatcttgatgacaaaaatgagtcgctacgccttgattaccgcgctggcgatgtttctcgccgggtgtgtggggcaacgtgaacctgcaccggtagaagaagtgaaaccagcgccggaacaaccagccgagccacaacagcctgtccccacagtgccctcggtgccgacgatcccgcagcagccaggcccaattgagcacgaagatcaaactgcaccgcctgcgccgcatattcgccattatgactggaatggcgcaatgcagccgatggtcagtaagatgcttggggctgacggggtgactgcgggtagcgtcctgctggttgatagcgttaacaaccgtactaacggttcgctgaatgccgcagaagcgaccgaaacgctgcgaaatgcgctggctaataacggtaaatttaccctggtttccgcccagcagctgtcgatggctaagcaacagttaggtttgtcgccgcaggacagtttaggtacccgtagtaaagccataggcattgcccgcaatgtcggcgctcattacgtgctatactccagcgcctctggcaacgttaacgctccgaccctacaaatgcagctgatgctggtgcagacgggcgaaattatctggtcaggtaaaggtgccgtttcgcagcaataatcccatcacgcgcgacgaattgctgtcgcgctttttcccgcagtttcatcccgtcacgacgtttaatagtgggcttagtggcgggagttttctcattgaacaccagggccagcgttttgttgtgcgtcagccgcacgatcctgatgcgccgcagtccgcgttcttgcgccagtatcgggctttatcacaactacccgcatgcattgcaccgaagccgcatttatatctccgtgactggatggtagtcgactatctgcccggcgcggtaaaaacgtatttgccggataccaacgaactggcaggcttgctgtattatctacatcaacaaccacgttttggctggcgaataacgctgttgccgttactggaactgtactggcagcaaagcgatccggcgcggcggacagtgggttggctgcgaatgttaaaacgtctgcgcaaagcgcgggaaccacggcctttacgcttaagtccattgcatatggatgtccacgccggaaatttagtgcatagcgcgtcagggttaaaactcatcgactgggagtatgcaggagatggtgatatcgcgctggaactggcggcggtgtgggtggaaaatactgaacagcacctgcaattggtcaatgactatgccactcgcgcgaagatttatccggcgcaattatggcgtcaggtcaggcgatggtttccctggctgctgatgctcaaagcagggtggtttgagtaccgctggcgacaaaccggcgatcaacaatttatcaggctggccgatgacacctggcggcagctattaataaaacaataaggagagcagtgtgggtccagtaatgttggatgtcgaaggttacgaactggacgcggaagagcgtgaaatactggcgcatccgctggtgggagggctgattctctttacgcgtaactatcatgatcctgcccagttacgtgaactggtgcgccagatccgcgcagcttcgcgcaatcatctggtggtggcggttgatcaggaaggtggacgcgtgcagcgttttcgtgaaggttttacccgcttgccagcggcgcaatcattcgctgcgctgtcaggaatggaagagggtggcaaactggcgcaggaggcaggttggttgatggccagcgaaatgatcgctatggatattgatatcagctttgcgcctgtgctggatgtcgggcatatcagcgcggcgattggcgagcgttcttatcatgccgatccacaaaaagccctggcaattgccagccggtttattgatggtatgcatgaagccggaatgaaaacgaccgggaaacacttcccaggacacggtgcagtaacggcagactcacacaaagaaacaccgtgcgatccacgtccacaagcggagattcgcgctaaagatatgtcggtcttcagttccttaatccgcgaaaataaactcgacgccattatgcctgcgcatgtgatctacagtgatgttgatccgcgtccggcgagcggttctccctactggctgaaaaccgttttgcgtcaggaactgggttttgacggcgtgattttctctgacgatttatcgatggaaggtgccgtgattatgggcagttatgccgaacgcgggcaggcatcactggatgcgggttgcgatatgatcctggtctgcaataatcgtaaaggggccgtcagcgtgttagataatctgtcaccgatcaaggcagaacgtgttacacgtttgtatcataaaggttcattttcgcgacaggaactgatggactcggctcgctggaaagcgatcagcgcccgtctgaatcagttacatgaacgctggcaggaagagaaagcaggtcactaaccctggcttatgtgaggaagcgatgattatctatttacacggttttgactctaacagtccgggtaaccacgagaaagtcttacaattgcagtttattgacccggatgtacgcttgataagctacagtacgcggcatccgaaacatgatatgcagcatctgctcaaagaagtggacaaaatgttgcaactgaacgttgacgagcgtccgctaatttgcggcgttggcctgggcggatactgggcggaacggattggttttctttgcgacatccgccaggtgatcttcaaccctaatttgttcccttatgagaacatggaaggcaagattgatcgcccggaagagtatgccgatattgccactaagtgtgtgaccaacttccgtgagaagaatcgcgatcgttgcctggtgattttgtcgcgtaatgatgaagcgcttaacagccagcggacatctgaagagctgcatcattattacgagattgtctgggacgaagagcagtcgcacaaattcaagaatatctccccgcatttgcagcgcattaaagcgttcaaaaccctcgggtaaatgccctcgtcgcatcaggtaaccttgccggtacctgatgcactccgaattctgtaagtcggataaggcgttcacgccgcatccgacagtcgagcatcaatgcctgatgcgatgctgcgcatcttatcaggacgaccaaacgccctcgatatacgcttcaccctatatcgccctttcggattcgctcaaataataaacaataaactctgttttttgatctcacccggtaaagtcgcctatcttttcagcaacaaaacttgattaacatcaattttggtatgaccaatgcaccattcatgttattctcaatagcgaagaacattttcattgctgtaacctgttgttaattaagagctatgttaataaccattaattaacaattggttaataaatttaagggggtcacgttgactacgccattgaaaaaaattgtgattgtcggcggcggtgctggtgggctggaaatggcaacacagctggggcataagctgggacgcaagaaaaaagccaaaattacgctggtcgatcgtaaccacagccacctgtggaaaccgctgctgcacgaagtggcgactggctcgcttgatgaaggcgtcgatgcgttgagctatctggcccatgcgcgcaatcatggtttccagttccagctgggttccgtcattgatattgatcgtgaagcgaaaacaatcactattgcagaactgcgcgatgagaaaggtgaactgctggttccggaacgtaaaatcgcctatgacaccctggtaatggcgctgggtagcacctctaacgatttcaatacgccgggtgtcaaagagaactgcattttcctcgataacccgcaccaggcgcgtcgctttcaccaggagatgctgaatctcttcctgaaatactccgccaacctgggcgcgaatggcaaagtgaacattgcgattgtcggcggcggcgcgacgggtgtagaactctccgctgaattgcacaacgcggtcaagcaactgcacagctacggttacaaaggcctgaccaacgaagccctgaacgtaacgctggtagaagcgggagaacgtattttgcctgcgttaccgccacgtatctctgctgcggcccacaacgagctaacgaaacttggcgttcgcgtgctgacgcaaaccatggtcaccagtgctgatgaaggcggcctgcacactaaagatggcgaatatattgaggcggatctgatggtatgggcagccgggatcaaagcgccagacttcctgaaagatatcggtggtcttgaaactaaccgtatcaaccagctggtggtggaaccgacgctgcaaaccactcgcgatccagacatttacgctattggcgactgcgcgtcatgcccgcgtccggaagggggctttgttccgccgcgtgctcaggctgcacaccagatggcgacttgcgcaatgaacaacattctggcgcagatgaacggtaaaccgctgaaaaattatcagtataaagatcatggttcgctggtatcgctgtcgaacttctccaccgttggtagcctgatgggtaacctgacgcgcggctcaatgatgattgaaggacgaattgcgcgctttgtatatatctcgctataccgaatgcatcagattgcgctgcatggttactttaaaaccggattaatgatgctggtggggagtattaaccgcgttatccgtccgcgtttgaagttgcattaatcgacgtacactggcggatgtggcataaacgcctcatccgccctggacaaatggttcgagcggtaggcctgataagacgcgttaagcgtcgcatcaggcattccttcagactcctccgaatcattaagtatttccagccattcccgcgcttttcatcttctgtctgatagctgcttttctccttcgcttgcatgattggcataactgcaaagaaggaggtgttcccgtgaataaatcaatgttggcgggtatcgggattggtgtcgcagctgcgctgggcgtagcggcagtggccagtctgaacgtgtttgaacgtggcccgcaatacgctcaggttgtttctgcaaccccaatcaaggaaacggttaaaacaccgcgtcaggagtgtcgcaacgtcacagtgacccatcgtcgaccggtgcaggatgaaaatcgcattaccgggtcggtgctcggcgctgttgctggcggcgtgatagggcatcagtttggcggtggtcgcggtaaagatgtcgccactgttgtgggggcgctgggtggtggatatgccggtaaccagatccagggctctctccaggaaagcgatacttacacgactacgcaacagcgttgtaaaacggtgtatgacaagtcagaaaaaatgctcggttatgatgtgacctataagattggcgatcagcagggcaaaatccgcatggaccgcgatccgggtacgcagatcccgctagatagtaatgggcaactgattttgaataacaaagtataacaaggctgtactctgcaatttggcccctcattcgctcaggctgaggggctttttttgcgacttatttcaccagttcgggccataaacgcaaagtcgttccggcaatctgcattagtttttccagcgatgcaccttcgcgtgcgctgatcgacatcccctgaataatacaattaaggaattctgccagatgtgtcacgtcacagtgggtcgggatttccccgcgcgcttgtcgttgacataaaaactgctgcaaagtgcgctcttgcatcgcatggcgtgatttcaacgtattggcgatatctcctgaatctggggagagggtggtgcagttgttgatcatgaagcagcctgccggggtgtctttgctggtaaagcagttggcgatggcagcaaaatagtcagccagcgcagactccacgcttttctcttcacaaaacagctgtgcttcatgcttagcggcaaaacgatcgatatagcggtcgagaacggcacgaaataacccctctttgttggtaaattccgcgtatagcgtgggcgctttggctccggtcgcttcgacgaggtccgcaagagaagtcgcttcataaccgtgttgccagaacaatttcatggccttatcaagcgcggcatccctgtcgaacacttttgggcggccacggcttttttttacacattgtgttgagtcagttgccatgatgccgttgtacctggtgactgtgaatgaaaggttattataaaaataatcacctccgttcaccagtccagatcccataaaaataattgctttctatttaactgaaatttaaagatttttaaattaattaatgattgttataaaaaatatcttgtatgtgatccagatcacatctatcatttagttatcgatcgttaagtaattgcttgcgacgtcattcatctgcataaggccactattatgaaaaacgtaaaaaccctcatcgctgcggcgattttaagctccatgtcatttgccagctttgcggctgtcgaagttcagtcaacgccagaaggccaacaaaaagtcggtacaatcagtgctaacgcggggacaaatctgggatcgctggaagagcagctggcgcaaaaagcggatgagatgggcgcaaaatctttccgtattacttctgtaaccggtccgaataccctccatggaacagcagtaatttataaataagcattaaccctcattaatgcctgctactgctgattttttccccgcgacatgccgtgtcgcggggattttttttatccaggatttacagagtttgtgggctcacttgatgacggcggacatccaccggcatcccggaacggacatccatcacatgttgcatcacttcagcgtcagtttgtgctgcatctttaaatgattgcattgcgctattcagcgtaattggcagcagctgcggatcgtcatcaatcttctctgacagcggctgatgtacttcaaccagacgcgcaccgtttggttcggcagagacttttatcggagtgttgatgatattcactttggtgcctggggtgacctggctaaagagtgttttgatatcgtcatcccgcagacgaatacagccagaacttacccgcatgccaatgccgaaatcggcgttcgtaccgtgaagcaaataaacgccgccataggccgccagacgaatcgcatgatggcccattgggttatccggtccagccggcactaccgcaggcaactcaattccctgtgctttataacgggcgcggatgtttgccgttggcgtccaggttgggtttgcacgtttgtctgaaacggtggtcaccattgtcggtgtcagcgtgtcaccacctaactgaccaatacctattggatacacggttaccgaatttttacccggcgggtagtaatagagacgcagctccgcaatattgatcacaatgccttcgcgcggcgcatctggaagtagggtttgcaacgggatcgttaacacgctacccgcgcgcggtacgtaaggatcaacgccagggttagcctgtaacagagcgagaaagccgacgttatattttttggcgatggcttccagagaaccaccgtcattttccaccacatgaaatttgttttcgccaaccagacgactgcccgctggcggcagcggccaggtgttggcttttgccggtagcgccagcgccacggcagcggcgaacgtaaaaaacgttagccagcgagaaaaacgcgttttgatcatcaccaaaaatccataataaatataaggttattgtaataaacagataagcctgaattatggatggtgacagtgtcggatagtgcagggaagtgcaaagaatttgtaaatgttgcagatgggggcgcagaaacgcccccgatttaccattaagcgatcgcgttctcttccagttcacgcataaactggcgtacccattcgatacgcgttttccgctcactcaaatcctgaataaatttcaggcgcgtcggaccatcaaggcggtaatgctgcggctgtttttgcagcaaaccaatcaaccaggccggattaacgtgattcttctcggcaaattcgatcaccccgcctttctcattaccttccagcttcctgatccccagtttctgcgcttgctggcgcagacgggcaacatccagcagggtacgcgccggatccggcagcaggccgaagcgatcgataagctcgactttgatctcttccagttcgttttccgttttggcgctggcaatacgtttatagaacgacaaacgcgtattcacgtcaggaatgaaatcatctggcaatagcgacggcatccgcagctcgacttctgtttgctggctggtgagatcttccagcgacggctcgcgtccggctttcagtgcatcgacggcgttttccagcaactccatatacagcgagaaaccgatggtttccattgagccactttgttcttcgccaagcagttcacccgcgccgcggatctccagatcgtgcgttgccagcgcaaagcctgcaccgagatcttccagcgaggcaatcgcttcaagacgtttttgtgcatcggtagtcatcgcttttggatgcggcgtcagcagccatgcatatgcctgatgatgtgaacgtccgacgcgaccgcgtaactggtgcagctgcgccagaccgaagtgatccgcacgttcaatgataatggtgttggctgtcgggatgtcgatcccggtttcgataatggtggtacaaaccagcacgttgaaacgttgatgatggaaatcattcatcacccgttccagttcgcgctcgcgcatctgcccgtgaccgatggcaatccgtgcttcaggcaccagttctgccagccgttcggcagctttctggatgttttccacatcattgtagagataataaacctgccccccgcgcaaaatttcacgcaggatcgcctcccggaccaccaggctgtcatactcacggacaaaggttttaactgccagacgacgggcgggcggcgtggcgataatcgacaggtcacgcattccgctcattgccatattcagcgtgcgtgggatcggcgttgcagtaagcgtcagaatatccacgttcgcgcgcatcgctttaatgcgctctttatgacgcaccccgaagcggtgttcttcatcgacaatcagcaggcctaaatctttaaacttgacgtcactttgcagcagtttgtgcgtaccgatcagaatatcgattttcccttccgccacttccgcaaggatttgcgtctgctctttggcgctgcggaaacgggagatcatttcgatacgtaccggccagttggcgaaacggtcgcggaagttgtcgtaatgctgctgcgcaagaagggtggtaggcaccaacaccgctacctgcttgtggttatctactgccaggaaagcggcgcgcatcgccacttctgttttaccaaagccaacatcgccgcacaccagacgatccattgccagcggctgacacatgtcgctaagtaccgcattaatggcctgcgcctgatccggcgtggtttcaaacgggaagctgtcgcagaacaactgatactgctcacgatcgtgtttaaacgcgaagccctctttggcggcgcgttgcgcgtagatatccagcaattccgccgccacatcacgcactttttccgccgctttctgccgcgcgcgtgaccacgcatcgccgccaagtttatgcagcggggcgttttcttccgcgccacctgcgtaacggctaatcagatgcagtgacgacaccggaacatacagtttggcgtcgttggcataggtgagcatcaaatactcgccagtaatgccgcccgcttcgagcgtggtcattccggcatagcgcccgacaccgtgctccagatggaccaccggctgaccaatatgcagctccgcaaggttacggatcagtgtatcggggttgatggtgcggcgagaatcctgacgacggcgggcaacacgttcaccgagcagatcgctttcgcagatcagcgccagattacgcaccgtatcgacaaaaccatgttcggcagcgccaatcatcagataacgcccacggtcgctggcttcatcaagacgcataatgcgttgcggagcaattttaattcgtgcgagcagttcacccagcgcttcacggcgaccttcactttctaccgagaacaccaccggaccgtcgaaagtctcgaggaacttacgcagcgcatccagcggcgctttttgttgcgcctgaacggccaggtctggcagtttctggaaacctaaattggcattcgcggcttttgtcggtaaatgttcagtttttagctgcacccggggccagtttttcagctctgagaagagctcgtccacccgcagccagagcgattgtggtggcaacagcgggcgcatcggatcgacgccgcgattctcaaaacgcgccagcgtgtcagcctggaaacgttcggcactggtttccagatcgccagtattcaccagcaaggtattggcagggaaataactgaacagcggcggcagtggttcgctgaagaacaatggctgccagtactcgatcccggcaggtaatgtgcctttactcacttgctggtaaatatgttccggatcgcgcttcacttcgaaggtatcgcgccactggctgcggaacagttcaattgccgctttatcggtcggaaattcgtgcgcgggcagcagattgatcgcttctacttcctccagcgtgcgctggctgtcgacgtcaaacacccgcaggctgtcgatttcatcatcaaagaaatcaagacgataaggcagctcactccccatcgggaagagatccagcaacgcgccgcgcgtggcgtattcgccgtgctccatcacctggtcaacatggcgataaccggcgctgtccagttgggttcgtaatgcatctcgtgacaggcgctggccttttttcatcaccagcgcatgaccgtggagaaaactgtgtgggcaaacgcgctgcataagcgtattcaccggaacaatcagtacgccacgctgcatcgtcggtagctggtaaagggtggaaaggcgcgaggagataatgtcctgatgaggcgaaaaactgtcgtagggaagagtttcccagtccgccagattcatcaccatctgatcggtgaactggctgatttcatcatgcaaacgcagagcattttgcatatctggtgcaatgagtaccaccggaccggcgtgacgttcggcaatttccgctaccagcgttgcacaggctgcgccggttaactcgcccagcagacgctgctcacccgctttgacgggcagcgtataacgatattgttcaggcataacggttgtcagattctcgttaggatatgcctcaacatatgggggcatatctctgataagcaatgctgttcattatccgtaatcgacatggtttagcaaattgaatcgccccggctggggcgatggcttagcgggagtaactgacggcagcgggcagtgaaggcggggagaacaacagatcgctgaatgcacgctgtgaaagttttcttaccagcaagcccgcaacagtacagatgaacaaactgacaaagggataaaccagcaggagtgtcagttcgacttgcggcgaccagcgtgctgcgttcatttgcgcaagcagagttaagctgaatatttcaaccagaatgcgatgggtggtgtagatagcaatggtgttggagccaatcacattcagcaggctggtggagcgcataccgaatcgttgctcgtattgataaaacagcttcatgatcaccacaatcgataccagcgacaacagcagcgagatagtaaacaaccaggcaccgaccgccagaacggtaagcaaagaagccattagcagatggcggcgcaacggcacctctttaacacaggtcattattgttgcgccaaaccatgcgccaaggctgtaataaggcaaattgcggatcacactgttcattccccaccacggcgtgggaacgaaattaaccgccacactcagcagtacaaacaaggcgaatagtagcagcgccagacggctaaaaattttacataccacgaaatagacaattaacgcatacagataccacaagctggtgctggcggtgatcatcccgtgcaggaactcaccggtggaatcggcataagcggcattggaggcattgcttaaatcgcgctcaggtgccagccactggttcagcgcacttaacgccagccactgcaccacgccccaaagcgccagcacccaaaagatgctccagatgcgtttatcgagacaatttccccacggtacgctgtcgatatagcggcgaatcaaatagccggaaataaagaaaaaaaacggcatacgaaagggtgcaaggtaaagattgaaatagatccagcatttgctcaggacttccgataacggatgctgaaaagtggtcagatgcggataaaaggtaatgaccgagtgataaatcaccaccagacaaatacataaccctttgatctggttaatccatagctctttttgtttcatcaggacaacacgctcttttttaatttacatgcggttgatcctgcgggttatgaccctatgtgtaatgggtatctgtctgtattggatgatttttcagattaagatcaggcggcaagattgatgataaaacatggcaatttagccgattgatttacgggggcttttcagattagccctgacgatcacttacagttcagacgtttacccatcttgctttcgcttatatactcgtgtctttgctacagcaaccagacggatttcatgtaccaacctgtcgctctatttattggcctgcgttacatgcgtgggcgtgcagcggatcgcttcggtcgtttcgtctcctggctttctaccatcggcattaccctcggggtgatggcgctggtcacagtattgtcagtgatgaacggctttgagcgcgagctgcaaaacaacatccttggcctgatgccacaggcaattctctcttctgagcatggctctcttaacccgcagcaactcccggaaacggcagtcaaactggacggcgttaatcgcgtcgcacctattactaccggtgatgtggtactgcaaagcgcgcgcagcgtggcggtcggggtgatgctcggtatcgacccggcgcaaaaagatccacttacaccgtatctggtcaatgtgaaacaaactgacctcgagccggggaaatataatgtcatcctcggcgaacaacttgcctcacagctaggcgttaatcgcggtgatcaaatccgcgtgatggtaccatctgccagccagttcacgccgatggggcgtattccaagtcagcgcctgttcaatgtgattggcactttcgccgccaacagtgaagtcgatggcaatgaaatgctggtgaatattgaggatgcctcgcgtctgatgcgttatccggcaggcaatattaccggctggcgtttgtggctggatgagccgctgaaagtcgactcattaagtcagcaaaaactgcctgaaggcagcaaatggcaggactggcgtgatcgtaaaggcgagttgttccaggccgtacgcatggaaaaaaatatgatgggtttactgctgagcctgattgtcgccgttgcggcgtttaacattattacctcactagggctgatggtaatggagaagcagggcgaagtagcgatcctgcaaacgcaaggcttaactccgcgacaaatcatgatggtctttatggtgcaaggggccagcgccgggattatcggtgcgatcctcggagcggcgcttggcgccctgcttgccagccagttaaataatctgatgccgataatcggcgtcctgcttgatggcgcggcgctgccggtggctatcgaacctttacaggtcattgttattgcgctggtggcgatggctatcgcgctgctgtctacgctttacccttcatggcgcgctgccgccactcaacccgctgaggctttacgttatgaataagatcctgttgcaatgcgacaacctgtgcaaacgctatcaggaaggcagtgtgcaaaccgatgtgctgcacaatgtcagtttcagcgtcggcgaaggtgaaatgatggcgatcgtcggtagctctggttccggtaaaagtaccttgctgcacctgctgggcgggctggatacgccaacctccggcgatgtgatttttaatggtcagccaatgagcaaactgtcgtcggcagcgaaagctgaactgcgcaaccagaagctgggctttatttatcagtttcaccacctgctgccggattttaccgccctggaaaacgtggctatgccgctgctgattggcaagaaaaagcccgctgaaatcaacagccgtgcacttgagatgttaaaagcggtggggctggatcatcgtgcgaatcaccgcccatctgaactttctggcggcgaacgccagcgtgtggcgattgcccgtgcgctggtgaataacccgcgcctggtactggcggatgaacctaccggtaacctcgatgcgcgtaacgccgacagcatcttccagttgcttggggaattgaatcgcttgcagggcaccgccttcctggtggttactcacgacctgcaactggcgaaacgtatgagccgccagttagaaatgcgtgatggtcgtctgacggcggaactgagcctgatgggggcggagtaatggcgatgcctttatcgttattaattggcctgcgttttagtcgcggacggcggcgcggcggcatggtgtcgctgatctccgtcatttctaccattggcattgccctcggcgtggcggtattgatcgtcggcttaagcgcgatgaacggctttgaacgcgaactgaacaaccgtattctggcggtggtgccgcatggtgaaatcgaggcggtggatcagccgtggactaactggcaggaagcactggatcacgtgcaaaaagtgccgggtattgccgctgccgcgccgtatatcaatttcaccgggctggtggaaagtggcgcgaatcttcgcgcaatccaggtgaagggcgttaacccgcaacaggaacagcgtctgagcgcattaccctcgtttgtccagggcgatgcgtggcgcaattttaaagcgggcgaacagcaaattatcatcggcaaaggcgtggcggatgcgctgaaagtgaagcagggggattgggtgtcgattatgatccccaactcgaatcccgagcataaactgatgcagccaaaacgtgtgcgtttgcacgttgccggtattttgcagttgagtggtcaactcgatcacagttttgccatgatcccgctggcagatgcccaacaatatcttgatatgggttccagcgtatcaggtattgcccttaaaatgacggatgttttcaacgccaataagctggtacgcgatgcgggtgaagtgaccaacagctatgtttatattaaaagctggattggtacttacggctatatgtatcgcgatatccaaatgatccgcgccattatgtatctggcgatggtactggtgattggcgtggcctgtttcaacatcgtctccaccttagtgatggcggtgaaagacaagagtggcgatatcgcagtattaagaacgctgggggcgaaagatggtttaattcgcgccatctttgtctggtatggattgctggcagggctgttcggcagcctgtgtggtgtgattatcggcgtagtggtttcactgcaacttaccccgattattgagtggattgaaaagttgatcggtcatcagttcctctccagcgatatctattttattgatttcctgccatcggaattgcactggctggacgtcttctacgtactggtcacagcattgttgctgagtcttttggcaagttggtatccggcgcggcgcgccagtaatattgaccctgcgcgagtccttagcggccagtaaaggcagtacattaaaacaaggagcggcaatgtattacgggtttgatattggtggaacaaaaattgcgcttggcgtgtttgatagcggtcggcagttgcagtgggaaaagcgggtgccgacaccgcgtgacagctatgacgcatttttagatgcagtgtgtgagctggtagctgaagctgaccaacgttttggctgtaaaggttctgtcggcatcggtattccgggaatgccggaaacagaagatggtacgctgtatgccgccaatgtccccgctgccagcggtaaaccgctgcgtgccgacctgagcgcacgtcttgatcgcgatgtacgccttgataacgatgccaactgttttgccctttcagaagcctgggatgatgaatttactcaatatccactggtgatggggttgattctcggcaccggcgttggcggcgggctgattttcaacggcaaaccgattaccggtaaaagctacattaccggcgagtttggccatatgcgtctgccggttgatgcgttaaccatgatggggttggatttcccgttacgccgctgcggctgtggtcagcatggctgcattgaaaattatctgtctggtcgcggttttgcgtggctgtatcaacactattatcatcaaccgttgcaggctcccgaaattattgcgctttatgatcaaggcgatgagcaggcaagggcgcacgttgagcgttatctggatttattagcggtttgtctgggaaatatcctgaccattgttgaccctgacctggtcgtcattggtggtggcttatcgaatttcccggcaatcacagcgcaactggcggacaggctgcctcgtcatctcttacctgtagctcgtgttccgcgcattgaacgcgcgcgccacggtgatgcgggaggaatgcgtggtgcggccttcctacatctaaccgattaaacaacagaggttgctatgctgtcgcgtcggggtcatcggttaagtcgttttcgtaaaaataaacgccgcctgcgcgagcgtttgcgtcagcgtatttttttcagagataaagtggtgccggaagcaatggaaaaaccaagagtactcgtactgacaggggcaggaatttctgcggaatcaggtattcgtacctttcgcgccgcagatggcctgtgggaagaacatcgggttgaagatgtggcaacgccggaaggtttcgatcgcgatcctgaactggtgcaagcgttttataacgcccgtcgtcgacagctgcagcagccagaaattcagcctaacgccgcgcatcttgcgctggctaaactgcaagacgccctcggcgatcgctttttgctggtgacgcagaatatcgacaacctgcatgaacgcgcaggtaataccaatgtgattcatatgcatggggaactgctgaaagttcgttgttcacaaagtggtcaggttctcgactggaccggagacgttaccccagaagataaatgccattgctgccagtttccggcacccttgcgcccgcatgtagtgtggtttggcgaaatgccactcggcatggatgaaatttatatggcgttgtcgatggccgatattttcattgccattggcacatccgggcatgtttatccggcggctgggtttgttcacgaagcgaaactgcatggcgcgcacaccgtggaactgaatcttgaaccgagtcaggttggtaatgaatttgccgagaaatattacggcccggcaagccaggtggtgcctgagtttgttgaaaagttgctgaagggattaaaagcgggaagcattgcctgatgcactacgcttatcaggcctgcaaggggaccacaataccgacgaaagagcgggataaaactttactgtcctgactcattagccacatccttgctaaataaaaaacgggcggtaatgccaccgcccgcttgctgaattaacgtcctgctttcagcttctgataatactcttcataaatgctgctggctgcgccaacgtcattctgccattcgccatttttaatggtttcagcatccgggtagagcgttttatcgttcgccacttccggacttaacagcttacgcgccgcaaggtttggcgttggataaccgatagtttcagcaacctgttttgccacatccgggcgcagcaggaagttgatcaatttcagcgcgccttctttgtttttggcatttgccgggatcgccaggctgtccatccagaaaatgccgccttctttcggccacaccacgtcaattggcgtacccgcctgccgtgcaacgaaagcagaaccgttccagatcatgccgaggttaacttcgccttccatgtacgggttagctgggttatcggagttaaacgctgcgacgtttggcatcagttttttcagctcattatatgcagcttcaatctctttcggatcggtggtgttaccggagtagcccagcttacgcagcgccatctggaacacttcacgggcatcgtcggtcaacagcaggctgcctttgtactcaggcttccacagatcggcccagctggtgacagatttcggatccaccgcatcaccgttaacaccaatcgccgtcgcaccccagatatacggaatggagtaatcgttattcgggtcaaacggcttattgagcatgtctggatcgagattgctgaagttcgttaacttcgacttgtcgatcttctggatcatcccttctttacgcattttatcgacgtaataggttgaaggaaccaccaggtcataggcaccgtctttgtacgttttcagcttggcatacatggtttcgttcgactcgtaagtcgaatagataaccttaataccggtttctttggtgaactgttcaagcagtcctggcggcacgtactcggtccagttgtagaaatacagcgtgttgttgtcatcggcgtgagcggcgctcatgcccagtgccagagcacccgccgcgagcaggtggcgtgaccattttttcatttaacgtcccctgtgttacctttcgttttatcacgagcaataagctggctggcaataaccatcaccagcgacagcaccagtaatatggttgccagcgcgttaacttccggcgatacgccgactttgaccatcgaataaatttttaacggcagaatttcatagcttggtccggtgacgaacgaagaaactaccacatcgtccatcgacagggtaaagcttaacacccagcccgccgccaccgctggcattgccagtggcagaatgatttttcgcagaatggtaaattcgctggcaccgagatctttcgccgcttccagcatccgcacgtcaaaacctttcaggcgcgaatacaccgtcaccaccacaaatggcaggcagaaggtgatatgcgagaacagcagcgaccagaagccaagctgaatacccagcagcataaacagcaccagcagcgaaattgccatcacgatatctggtgacatcattaccacaaacagcattccgctaacgaacggcttaccgcgaaagcgataacggtacagcgcaactgccgtcagtgaaccgataagcgtagcaaacgtcgccgaaaacaccgccattgttagtgaatgctgcgctgcctgtaacaggctgtcgttgttcatcagcaggctataccatttggtggtaaaaccctgccagttgatgccaaagcgcgagctgttaaaggagttcacaatcaaaataatgattgggatatacaggtacgcgtagatagcggtcataaaaccgccgcgaagcagtcgaccgatcattcgagttccacctttttattcagcagacgagaagcgcgccagtaaaccagcaacatcaggcccattacgatagtcagcgtaatgctggtggctgcaccaaacggccagtcacgaatattgaggaactgtaccttgatgacgttaccgatcagcaggtttttcgcaccgcccatcaggtcggacacatagaacaggcccatcgctggcagcatcaccagcagacatccggcaataatccccggcatcgtcagtggaataattatgcggataaaagtctgtaacttgctggcaccgagatcgcgcgccgcctcaagcaacggcttatccagtttttcgatactggagtacagcggcatcaccataaacggcagcagaatgtaaaccagaccgataatcaccgcactgggcgtgaacatgatacggattggtgtgtcgataacgcccagccagagcaaaaactcgttgagatagcctttggtgctgaggaaaattttcagcccgtagatacgaatcaatgagttggtccagaagggaacaatcagcagaaacagcagcagcggacgcaccttgtgtggcagcttcgccagaaaccaggcaaacgggtagcccagcaccaggcaggcgagggtggcgatcagcgccatattcagcgagtgcaatagcacttcaaaatagagcggatcgagcagacgcgtgtagttatccagcgtaaagaccattttgacgaaactggcgtcgtcgcgggtcaaaaagctggtgccaatgatcatcaggttgggcagaaagacaaacaacacaagccaaccgacaatagtgacaatcactacattctggaacttacttgtgttcttcatcagccagtacgacctcccagctttctacccaattaatggccattttttggtcgagagagtggtcaaagtcagggtcgtcttcattgaagaattcgctgaccatcaccatcttgccattttccagttcaacaaccgactccagcgtcatgcctttgtagttacgctcacgaacgtaaccaatcagcccttcagcgtggttgtcgtcgttaatctcttcaacacgtaagtcttccgggcgcagcagaacatgcagtttttgccccggttcaacggcgaagttaacgtagatattacattcgcggccttcaacgttggcgcgtacgcgctgctcgtcgagacgttcgatgacagtggcgttaaacatattgatttcgccaatgaagccggcaacaaacaggtttttcggctcttcgtaaatttcgcgcggtgtaccatcttgctcaatacgaccctcgcgcatcaccacaatcctgtctgacatggtgagcgcttcttcctgatcgtgagtgacaaagacgaaggtaataccaagcttacgctgtaacgctttcagctcgttctgcatttgcttgcgcagtttgtaatccagcgctgagagcgactcatccagcaacaacagacgaggcttgttaaccaccgcgcgggcaatggcgacgcgttgctgttgaccaccagagagctgatgcggtttgcgttgagcgaaggtttccagctgcaccatccgcagggcttccatcacgcggggcgtaatttcagcagcgggggttttttgcatgcgcaacccaaaggccacattttcgaacacggtcatgtgggggaaaagtgcgtagctttggaaaacagtgttcacatagcggttttccgccggaacgtgggtgatgtcctcgttatccagcatgatgcgtccggaatcaacagtttccagacctgcaatcaggcgaagaacggttgttttaccgcagccagaagggccaagcagcgtgaggaactcgccattgttgatagtcagatccagctggggaatgacctctttaccatcaaagcatttgcgaattcccgccaattgcaccagcggtgaaagcgaactcggttgtttattcaattttttactctgtcccatgtaaacgcaacggatggcttaccgatgcggggtttgtggttaaccaccttggtgactcttaatgagggcggtaattctacggcaaaccgcttgaatcgccaatctttgttgtgaattactggcttagctttatattcattaaggtaatgctgataaatattcccgcttgcaggggtaaaagtgacctgacgcaatatttgtcttttcttgcttcttaataatgttgtcacaaaaagtgagggtgactacatggataaactacttgagcgatttttgaactacgtgtctctggatacccaatcaaaagcaggggtgagacaggttcccagcacggaaggccaatggaagttattgcatctgctgaaagagcagctcgaagagatggggcttatcaatgtgaccttaagtgagaagggcactttgatggcgacgttaccggctaacgtccctggcgatatcccggcgattggctttatttctcatgtggatacctcaccggattgcagcggcaaaaatgtgaatccgcaaattgttgaaaactatcgcggtggcgatattgcgctgggtatcggcgatgaagttttatcaccggttatgttcccggtgctgcatcagctactgggtcagacgctgattactaccgatggtaaaaccttgttaggtgccgatgacaaagccggtattgcagaaatcatgaccgcgctggcggtattgcaacagaaaaacattccgcatggtgatattcgcgtcgcctttaccccggatgaagaagtgggcaaaggggcgaaacattttgatgttgatgccttcgatgcccgctgggcttacactgttgacggtggtggcgtaggcgaactggagtttgaaaacttcaacgccgcatcggtcaatatcaaaattgtcggtaacaatgttcatccgggcacggcgaaaggagtgatggtaaatgcgctgtcgctggcggcacgtattcatgcggaagttccggcggatgaaagcccggaaatgacagaaggctatgaaggtttctatcacctggcgagcatgaaaggcaccgttgaccgagccgatatgcactacatcatccgtgatttcgaccgtaaacagtttgaagcgcgtaaacgtaaaatgatggagatcgccaaaaaagtgggcaaagggttacatcctgattgctacattgaactggtgattgaagacagttactacaatatgcgcgagaaagtggttgagcatccgcatattctcgatatcgcccagcaggcgatgcgtgactgcgatattgaaccggaactgaaaccgatccgcggtggtaccgacggcgcgcagttgtcgtttatgggattaccgtgcccgaacttgttcactggcggttacaactatcatggtaagcatgagtttgtgactctggaaggtatggaaaaagcggtgcaggtgatcgtccgtattgccgagttaacggcgcaacggaagtaagcgaaaagggatgcggcatgtgatgccgcatccggcttaaatccaaacttacccttcgaagaaccagtatccgctattgaccagcgccgcgagcatcgcgaggaatgacggatcttccagcgcatcgccaaaattctccgcggtcagcgcaatgttgctggcgagtgcatccagtgccggacggtgcggggaatcgatcttctcaccattggcatacacgtcgtcgccaatgcgcaatacgcgcagaccacccaggcgcaccagcacatcaccttgtttcagcgcatcgtagatttcatccggctgataaggcggctctggcggcgcgatatccagttcatgacgtgactgggatataaactcgccaaaccattgcttaaagtgttccggctggttgatcaattcgagcatcatctcacgcagtttatccatctcttgcggcagaacgtccgcaggatgagcgcgaggtggaacatcaggatcgctgtagtagttgccgcccagttcacgttgcagcacataatcggcaaatccgctaattaattcccgcgtatttggcgcgcgaaaacccacggaatagttcatcgcattttccagcgcgtagccttcatgcgggaatcctggcggaatataaagaatatcgccaggctccagctcttcatcgatgatggcttcgaacggatcgacctgtaacagatccgggtgtgggcagtgctgtttcatttgcagcttttcgcccactcgccagcgacgacgtccggtaccctgaatgataaacacgtcgtactgatcgagatgcgggccgacgccgccgccaggtacagaaaaagagatcatcagatcatcaatacgccagtccggtagttcacggaacggtcgcatcagcgcggcggtcggctcatgccagtgatttactgcttgcactaacaatgaccagttagtttcaccgagatgatcgtagctttcgaacggaccgtggctgacctgccatttgccatcctggtgactgaccagtcgactgtcgacttcgctttccatcgccagacccgccaactcgtctggagagatcgggtcaataaaattattaaagccgcgttttaacaccaccgggcgtttctgccagtgacgttcaagaaaatcgggccagttaagagtgagttggtattccatgttaagcatccacaggctggtatctgcaaccgattataacggatgcttaacgtaatgcgtgaagtatggacatatttattcatctttcggcgcagaatgctggcgaccaaaaatcacctccatccgcgcaccgcccagcatgctctctccggcgacgattttaccctcatattgctcggtgatttcgcgggctaccgccagccctacaccttgcccagggcgtaaagtatcaacccgttgaccacggtcgaaaatgacctctcgcttgcttaatggaataccgggtccatcatcctcgaccacaatatagagatgctcgtcggtttgccttgcagaaatttcgacaaactcgaggcaatatttacaggcattatccagcagattgcccatcacctcgacaaaatcgttctgctcaccgacaaagctgatctctggcgaaatatcgagagagatattgacccctttgcgttgatacactttgttcagcgccgaggtgagattgtccagcagtggggcgaccggatgcagctcgcggctaagcaatgtcccgccgcgcatactggcacgatgcaggtagtagccaatttgctgtgaaatgcggctgatttgctccagcattaccggttcagcatcactgacgctcatcttttcactacgcagagaacgcagcgtactttgcagcaccgccagtggcgttttcagactatgggtcaggtcggtgagcgtcgtacggtatttgtcgtaacgttcgcgttcactttttaacaatcggttcaggtttcgtaccagactggtcagttctcgcgttgtggctggattgagcaattcgcggttatgttcttccagttcgcggacttcttttgccagggcttcgatggggcgtaaactccaccaggcggcgacccacagcagcgggatcactaacagcagattggctgagagcacatagataaaccagctccagaccatataggaactttttagctccaccggaatggtatccaccaccacaatggttaattttggcatccgcgatgttgccgggtagacgtttactgccaccgagtgggtcatctccgcgtcgtcgtcatcttcccgcacttcctgcaactgttgctgtatcgaatgatctccactcagcaagaggctggtatcgttaacatccgcttcaatttcatgaaaaccattcgatttcagccagtcaggctggatcatcttcatcagccagggcacgtcacgttgcgcccataaaagctgcccgttctcatcataaattagcgtcatggtggggctttgcttgtcgatattttctggtaactcgacatgcaacttattgttttcccacttcgcaagggtatagaacagattgctttcgccacgtaacagccgaaacgtagttttatcgaaactgacgctataaccgatcagcgcgaccattccgtaggcaagcgaaagcaccagtactaccgctgccgttgccaacagaaaacgtacccgcagcgagagcgggaaaaaaagacgcagtaattttttcatcagcgcaattcgaacagatagccctggccgcgaacggtggtaatcacttcttgcggatattgtgcctgaatttttttgcgcagacgtcccatcagtacatcaatggtatggctttcccgcagctccgcatccggatagagttgtagcattaacgaatctttgctcaccactttgccattattgcgtatcaacgtttccataatggtgtattcgaacgcggtcagtttgatcacttcgtcattaatagataattcacggcgagagagatcaacctgaaacggggggagcgaaatgacctgtgaagccagaccgctattacgccgcattaatgcctgcattcgcgccatcacctcttcaatatgaaacggtttagtcacataatcatcagcaccggcacttaatacttcgactttgtcctgccagctttcacgggcggttaataccagaatcggcagtgaaacatcgttgctacgccagcggcgaatcagtgacagaccgtcctcgtctggcaatccgagatcgacaatcgcaatatccggtatatgttcattgagataataatcggcttctttggcatcttctgcgtcatcgacctgatgaccagcatcctgaatctgaactttaaggtggtgacgtaacaacgcattgtcttcaacaaccagtacgcgcatttttatttctccctgtcttaattattaaaatagtgtaacgcgattatgtggttatgggggtaaacattaaataaaccagcggggaggggaggtaaagtgaaaaaataaaaagcggataatcttaataagcaggccggacagcatcgccatccggcactgatacgaggtttatttcagctcatcaaccatcgtgatagctcgaccaatatagttagccggcgtcatcgctttcaggcgggctttctcttcttctggcaacgccagaccatcgataaactgcttcatgccttcggcgtcaacgcgcttaccgcgagtcagctctttcagcttctcgtacggtttttcgatgccatagcgacgcataactgtctggattggttcagccagcacttcccagttgtgatccagttcatccagcagatggtcacggttcacttccagtttgctcacgcctttcagggtggattgatatgcaatcaaggcataaccgatacccacgccgaggttacgcagcacggtagagtcggtcaggtcacgctgccagcgggaaaccggcagtttgcttgccagatgctgcaataccgcgttggaaaggcccagattcccttcggagttttcgaagtcgatcgggttaactttatgcggcatggtggaagaaccaatctcaccagcaatggttttctgtttgaagtggttaagggcgatataaccccagacgtcacggtcaaagtcgatcagaatagtgttgaagcgcgcaacgcaatcaaacagttcggcaatgtagtcgtgcggttcgatctgggtggtgtacgggttccactgaatacccagcgaggtgacgaactcttcgctgaactgatgccagtcaacttccgggtaagcggcgatgtgggcgttatagttaccgaccgcgccgttgattttgccgaggatctccacctggttaagctggcggtactggcgctccatacggtaggcgacgtttgccatctctttaccgatggttgacggcgtggctggctgaccgtgggtacgagacagcagcgggatatcgcgatactgaacggcgagatctttaatgccatcaatcagttgacgccagtatggcaggatcacttcatcacgcgcggttttcagcattaatgcgtgggagaggttattgatatcttccgaagtacaggcaaagtggatgaattcagaaaccgcgtgcagttccgggatctccgccactttttctttcaggaaatactcaaccgctttaacgtcgtggttagtggtacgctcgatagttttgatgcgcgccgcatcttcttcgctgaaactggcgacgattgcatcaaggtaaccgattgcgtcggcagcaaaagcaggaacttccttgatcgctgcgtgcgcggccagtttttgcagccaacgtacttcaacttgtacacggaatttcagcaaaccatattcgctgaaaatcccgcgcagcgcgctgactttatcgccgtagcgtccatcgacaggggaaacggcggtcagtgaggataattccatagatcacaactccggggttaaatgagcaagaatttgttttgcctgagtggtcaggcgattacgagaaaacatcagttgcagacgtccgccgccgacctggtgccagagcacggcggcgcgaatgcctgccagcagggttgcgcgaactttcgcctgcacttgtgggctttgcagtacagcaggggaaccggtgacctgaatgcgcgggccaagcgggctaatcacatcaacatagatagcagccatcgcgctcatcagcgtttcggactgtaaatcgaagtgttcgagctggcgttgcaggccgttgatccggttgcccagagtgtcgagcgcgcctttcgctgaggagagtttgcgctcaagcaccatcaagctgagtgtgtagcgggttaattcggcgtttaagccctggcgactgctggcattgagcacgccgagcagggtttccagcccgacgcgcaggttggcttcgctaccgccaaaaaccgccagcgtcgagctggggttcatatcaataatactgttgagtgagacgtgtagcgcatcggcatcacaatgcccctggtgagcgagttgttgcaccaggcgtgccgactgacaaataccggccagggcgagggtgatgtcatagtaattctttgccacgttcactgcttccttgttttaagtaaagataataatcagaccggcagcggcagacgctgctcaataataccgccaccgaggcacacttcaccgttatagaagacggcagactggcccggcgtcacggcggcaaccggttcatcgaaaatcacttcaatgcgatcatcgtccagcgccttgacggtgcaagggatatcggtctggcgatagcgggtttttaccgtgcaacgcatagtgccggtgaatggttcgcgatcgacccagtgcaactgctgggcaatcaacccgacagacatcagccgcgggtgttcatggccctgagcgacaaccagaatgttgttttcgacgtctttgtccaccacataccacggttcttcggtaccttctttggtgccaccgatacccagacctttacgctgaccgagagtgtgatacatcagcccctggtgctcaccaatttcatcgccatcgacggtaatgattttgcccggttgcgccgggagataacggcccaggaactcgcggaatttacgttcgccaatgaagcaaatgccggtagagtcttttttcttcgcggtgaccagaccaagatcttcagcaatcttacgcacctgcggtttttccagttcgccgaccgggaacaggctttgcgcaatctgctcatggctgagcgtataaaggaagtagctctggtctttattgctgtccagaccacgcagcaggcggctcttgccatcgacatcggcccgacgtacgtaatgaccggtagcgatataatcggcacctaaatcttcggcggcaaattcgaggaaggctttaaatttgatctctttgttgcacagaatatccggattcggcgtgcgaccggctttatattcggcaaggaacagttcgaagacgttgtcccagtactcggcagcaaagttaacggtgtgcagttcaatgccgagcttgtcgcagacagcctgggcatcagccagatccgctgccgctgtgcaatattcctcaccgtcgtcttcttcccagttcttcataaacaggccttcgacctgatatccctgttgttgcaacagccaggcagaaacggaggaatcgacaccgccggacatgccgacgattactttttttgcggtttcagacattggatcactcacgacattgaacttcaaggcggcgtattctatcacgcagccttttagatgacaccctttgtaaaaggccagttaaaatcgccaatcatctccagcggataacgttgcccgctttgataacaacgaatactttccgccaccagcggcgaacgaagatttgacgcctgtaaaatttcttcggcgctgacccaacggcagcagtcgatatcgctgtcatgaggctgggtcgggcatatttgctcaagctcaatggcaaagaggaaacgcaaaaacggcgttttatctggcgcaatccactgatgcatacgaataaagtgttgcggctgcgcgctgatgccggtttcttcccacagttcacgggcggcggcttccactaaggtttcatcggcttccagatgcccggcaggttggttccataacgctttaccattaatcgtctcttcaacgactaaaaatttgccttctgcgtgcaccacgcaagcaacggtaacgtgcggtttaaacattttgcatccttaatctgtcacttctcgccattcgccattggcaagattatccaaagagtaatcacccatcgcatagcgaatcagtcgcagcgtggggaagccaacatgggcggtcatgcggcgcacctggcgattacgtccttcatataaggtgatcttcagccagctggtgggaatacttttgcgttcacgaattgatggattccgcggccataaccacgcgggttcgtcaaccagctccgcgccggcgggcagggtagggccatcatttaaggttacgccattgcgcaaggcttcaagtgcgtcttgtgtgggaataccttccacctgcacataatagatttttccggtgcgtttacccggctgggttaaacgcgcctgcaacgcgccgttattggtcagcaccagcaacccttcgctatcgcggtcaaggcgacctgctgcataaacgccctgaaccgggatgaattcttttaatgttttgcgtccggcttcatcggtgaactgcggaagaacatcgtagggtttattgaacaggatcacacgcgtgggctggttttcaggtttacgcctggtagaacgttgcgagctgaatcgcttaacctggtgatttctaaaagaagttttttgcatggtattttcagagattatgaattgccgcattatagcctaataacgcgcatctttcatgacggcaaacaatagggtagtattgacaagccaattacaaatcattaacaaaaaattgctctaaagcatccgtatcgcaggacgcaaacgcatatgcaacgtggtggcagacgagcaaaccagtagcgctcgaaggagaggtgaatggaaagtaaagtagttgttccggcacaaggcaagaagatcaccctgcaaaacggcaaactcaacgttcctgaaaatccgattatcccttacattgaaggtgatggaatcggtgtagatgtaaccccagccatgctgaaagtggtcgacgctgcagtcgagaaagcctataaaggcgagcgtaaaatctcctggatggaaatttacaccggtgaaaaatccacacaggtttatggtcaggacgtctggctgcctgctgaaactcttgatctgattcgtgaatatcgcgttgccattaaaggtccgctgaccactccggttggtggcggtattcgctctctgaacgttgccctgcgccaggaactggatctctacatctgcctgcgtccggtacgttactatcagggcactccaagcccggttaaacaccctgaactgaccgatatggttatcttccgtgaaaactcggaagacatttatgcgggtatcgaatggaaagcagactctgccgacgccgagaaagtgattaaattcctgcgtgaagagatgggggtgaagaaaattcgcttcccggaacattgtggtatcggtattaagccgtgttcggaagaaggcaccaaacgtctggttcgtgcagcgatcgaatacgcaattgctaacgatcgtgactctgtgactctggtgcacaaaggcaacatcatgaagttcaccgaaggagcgtttaaagactggggctaccagctggcgcgtgaagagtttggcggtgaactgatcgacggtggcccgtggctgaaagttaaaaacccgaacactggcaaagagatcgtcattaaagacgtgattgctgatgcattcctgcaacagatcctgctgcgtccggctgaatatgatgttatcgcctgtatgaacctgaacggtgactacatttctgacgccctggcagcgcaggttggcggtatcggtatcgcccctggtgcaaacatcggtgacgaatgcgccctgtttgaagccacccacggtactgcgccgaaatatgccggtcaggacaaagtaaatcctggctctattattctctccgctgagatgatgctgcgccatatgggttggactgaagcggctgacctgattgttaaaggtatggaaggcgcaatcaatgccaagaccgtaacttatgacttcgaacgtctgatggaaggcgctaagctgctgaaatgttcagagtttggtgaagcgatcatcgaaaacatgtaatctctccatgtgttaaatattgaaacgggcgtataacacgcccgttgttttatttatgtggatattattaatagcatatcgagcatatttatatgaagcccattacttgagcccatatgggcatatttttataatgcaactattatgtaaacatttatttgttattttgctttctcctggaggacactcttgactgcttttgagtaaactccataaatccttgttgaatggtgcgatgtgataaatagtaataggatattctttatccttaaggataataccagacttaaccggtgtaaatatactgccaggagggagaaatatagtagattgataccagatgatcattttcatattaccccatatggctgaaaaagatataccacatgtaggttgaattaccgtgtcaattactatccacttcatttgttatgtcttatcccacggtatttaatatggttcattaggatgtttatttcttgattttgcatatgagtatattaccccccccccctcaaaaaaataaattaattaaaatgatggcttatataaaataaaatttaaagcaaggaatctcaatggatgttaaacaaaatgagattttgtgaaagcaataaattattgacttcgttttagatttgtttagctataatgttatacattcaaatgactgaacatcctgtaattaaaacatagcctttatgctactttgtgccaatttgctaaacattatggttgcctttttatataacgataataatgaatataagcatgacatgagaataagatttcaatttttgagttatataggaatgatttaacctgttcctggctaaaatacatataaccggatgatgactaaaccaaaatacatgtgcgttaagtattgaaacggacgtgtggcacggccgttgtttttataaatatgttaaccgttataaaataacgtatcaaaagtcaagtgatcacatttcaaatatcaagttgatagtattagtctggtgattatttatgggtgacaataaaaagacagtattaatcatccatagagatagtctctgcacttttatttccattatgctaatgccttactgaattatgaagcatttcttaagtatccaactttagctagattaatggtttattattttctacatcttcaatatataaaagcgtattatcaatggcgtagtaactgcgtttgttatgattaacatcagtaacccaccggaaaacgcccgcgcctgccagtgttgaacagtattcccgaaatgtagattttccgcaaatatgaagcaatgcggcctcttttattttagcagggttcttggtcgtactaacttttaacaggttcctggttcctcttaataacaaaaccgtatcatcgtgagtaataattctgatgttatccgtagccagataataaatgtaatgtgcaatacggtgatgttttaattctgaataaaaccaggagaagttttgctcttttctcacttgctcaaacatcttttgaaaaacaacgacctgatccatcaggataataacctcttgttagttgtgagactgcgtagtgtgcacgatcggttttaccacttcaatctggtctgtcctttggctgtgatatgtacagagtgtgatagagggaatatctgaattctcccggtgagcattttgcaacggaccagctccggtacaaacgctgttgtgggttcagattataacattctgtctaaggggcgggataaaggtgaaattagggggcatgaaagatgactttataaccttgctcaccccagtgttgtaaaagttcgttttgccttctcgttggtgccatgcctgtccagacaatcaatgtttgcgtcgggaacagttccgggcgcggcgattcaatgggatcagcaagaacagaaatgtgccatcctgacaatgataaacgccatgcttccagccacaatcgtgctctctcttcaacattccacgccatcagaatggcttctttaccgggcttacggcgcatttcgaaaagcgaggttgctgcgtattcaattaatgcgccgtcaaacatactgctcataatgcgggaggtgttgtgatcaagcacgagacgctggcgaacaggaaggtaaacatgattaatcaattgatctactgggtactctcgacccagtgaaataattctcgcgcgtagtttggcaggattagccatgcgaagaattgacatcatctcttcttgcaggcggctccagtcatcttccgtatcctggctggtggtttccagtaatgctttaactttgcctacagggacgccattacttatccaacgcttgatctcttcgatgcgttgtatgtcttcttcatcaaagagtcggtgtccgccttcactgcgctgtggttttaacaaaccgtagcggcgttgccaggcccggagagtgacaggattaatcccgcaacgttcagcaacatcaccaatgctgtaataagccacaattcctccttgcggtcacaaatctccgtcgcctgtacacgacccaataatactttgtacaatatacgctaaaattgtacaaagtataaataagatttcagctaaattggatgaaacattatttttaatgtggattaaatttaaacgtaacgtattcattttcacgatgatttactgaaatcatgtgaaagaatgtgctgaaaattattttttctctggccacgctatggaagggataccattcaatttagctttagcaaacagatctccctgaaacatctcaattcctgcggattcaagccacatccactcttctggtgttgccacgcccatagcactgacttgaatttcaagtgatgtacagcattttatgatcgcctgaataattgcctgccgtggcccacttttatgaacattggtaatcaattcctgactgattttaattctgtcaggctggaagcgtgacaggagtaacaaaccagcaaaacctgcgccaaaatgatcaattgctacactgataccagcagcctttagcgatttaatcgcttcggcaaactcatcaaaccgagatatgacttcactttcagtaaattcaacgatgatttgttcaggcaccagagcattggcctttatttcattaagtaaaaaagagactgcgtcaggttcgttaaccagggtcataggtaatagattgattgaaatcattttatcaccgagctcaagtgcgtgtgccatcgtgaatgcaagcgccttacttttgagatccgctgtgtagatttccccgtctttacgctgcccaaccgctatggctgatgggctatcttcatttttttgcacaatggcttcaaaagcgattatccgccgcgataagggatcgacaataggatgaaaggcaaagtggtcgtttatagttggtgaaagggcacaggaatcaagttctttatcagatccgtcagcgataaaaagccaggagtcttcggcagggatctcgaaataggttgattgttcggttgcaaggacaaaagtacgaaaaaattgtagcgctctgtcatcataagttagctgaaattttgatgtgcctttgtcgaatacggcctgtaaaacgtcatctcgctcgtgcaggcgcaaatcaaataattccattcccgctttgccaaaacggcgagcaggcgcgtaatcgcacagcagctcaacaatattatagtgccgtggatcctggcatatagcccgatatatcattttaacctgttcttccggaccttccagaagctggaaaaaatgagaaccattaaacagtaagatccctgttacgtcagactgcatgttcctgcgatttgctatcgaaaccatttcttcgatttttttgacaggttcgtcgtcacgtatatggctacgataaataagggtggtaagcattaacaatccagggtaatgggtgaggcgagagtaagacggtaacagacatatcttcttgtgtctttcttttaataccaaaacataaccgtttctttacattgataaaaaatggaaaagttgaacactagttggcgaaaaatcttgtatagattgtcagttaaatgatgcaatattttttatcataacacattgttttatatgcattagcactaattgcaaaaaattaatttatcattctgtacacatatttcgtacaagtttgctattgttacctcacttcacattgattaacatttttaacagaggcgtagcatgcatcaaaattcagtgacttcagattctgcgggagcaatcactcgttactttgcaaaagctaacttgcctactcagcaggaaactctcggggaaattgtgactgagattttgaaagatggacgtaatctgagtcgaaagtcgctttgtgccaaacttctttgccgactggaacaagcgacaggggaagagaaacagaaacattataatgcactaattgggttgctttttgaataatgcaacagcctgattttttaacaggttagctatgaagtcgttatgaagacatctgataatgaacgtataaaatgaatcgccacggataatctagacacttccgagccgttgataatactggttttcatattctgtcggtgacatctgttcgctagaaccatgccgacgcttactgttataaaacatttcgatgtaatcaaaaatatcactgcgggcttcttcccgcgttccgtagatctttttctttatccgttcacgtttcaacaactggaaaaaactttctgcaaccgcattatcatggcagttaccgcgacggctcatgctaccctccaggccgtgtgatttcaggaacgactgccactcatggcttgtgtactgactgccctgatccgaatgaaccagcacctgtttttcgggattacgccgccatacagccatcagcagtgcgttcaggacaatgtcctttgtcatccgggattgcatggaccagccgataattttgcgtgagaacagatcaacaacaacggcaagatacagccagccttcgtgggtcctgatgtaggttatgtccgttacccaacgctcatcaggagcatccggattgaactgtcgctggagcctgttgggtgacacgatactggcctcgcctttacgtgcccgcgggcttcggtatccgacctgagcctttattccgacacgtttcatcagtctccagactctgtttactccgcactgttgcccgctgtcacgcaaatccagatggattttgcgataaccatagacgcatcccgattccagccagaactgtttaatctgtcctgtcagtctcaggtctgcctgatggcgttgtgaatgcggctgctgaagccaggcgtaaaaaccactgggatgaacatccagcacccgacagagcaggcgaacaggccagcaacaggagttgtcacggataaaggcgtacctcagtcggacagctttgcgaagtacgccgcggctttttttaatatgtcccgttcgtcggtaacccgtttcagctctttctggagacggcggatctcggcctgagcatctgactgttctttattagtggaagaatccggaccgtacttctttatccaggcataaaggctgtgggtggtgatatcgagacgtgttgcaacgctggcaacagaataaccgcgatcaacaacctgtttgactgcttcagttttaaactcttcgggataacgcttaccgctcatgggcacctctctttaagccatcttaaatgactctgaggtgtctgttaaacccgtggcgattcaaaatatgaaattactggccaggcggtgctccagatactgcgcatgaagataaatttttcattgcagactcttattaagcaattactcgtaatgaaatcggctgaggaagatgctttccgacgcgatttaattgacagcataattcgtgattttagcaatagtgattcaggagggccaaaccgaagaacagcgacagctgacaataaaagtatgttcaatggttggaaaataaacagaatacattaaaatttcataagtaagatgagaggttaccatgcttgaagatactacaattcataatgcaataactgataaagcgttagcaagttactttcgcagttcgggtaatttgttagaagaagagtcagcagtgttagggcaggctgtcaccaatttaatgctttcaggcgataatgttaataataaaaatattatcttaagtctgatacactccctggaaacaacaagtgatattctcaaagctgatgtgattagaaaaacactggaaatcgtgttgcgatacacagctgatgatatgtaacttctaattattaagtataagtttatagaaaactcattcatcttatttttgtctgtcgctttagactatacacagcataattttattaggttaatatttctacgaggctgacatgaataattcaatcccagagagatttatttttcaatgtgctttgtttaaaaatctcgagagggaggtgttcatgacgcatgggtatgttgatagtcatattattgatcaggctttacgcttgcgtttaaaagatgaaaccagtgtgattctttctgatctctatctgcaaatattgcagtacattgaaatgcataagactacactaacggatatcattattaatgacagggaatccgtgctctcttagaacttgagtaaggttttagaataaacatcagctgtatcaccatgctgatacaaagtgagcatttcaggcgttatgctttcttattatgtccgcaatatcaggtgtcaagaatggagagttctcgctctccattcttgacgcctgatatcccgcctaacttattttgtactgcctacattatgctcaataattaatgggttagatcaagatggagaaaattttatcttcggcgtggatatttcttatgctctctaccatgctctctgtagatgccagcgcgagcgaatgaatggcattttcatgtattaaaccctttggccgggacaagcaaatgcgcaatacactcatacccatcctcgttgcgatatgcttgtttattaccggtgtcgctattttgaacatccagctctggtattccgcaaaagcagagtacctggcgggagcgagatatgccgccaacaatatcaatcatatacttgaagaagcgtcacaagcgactcaaacagcggttaacattgccgggaaggaatgcaacctcgaggagcaatatcagcttggcactgaagcagctctgaaacctcacctgcgcacaatcatcattctcaaacagggaatagtctggtgtacatccctgcctgggaatcgggtcctgttgtctcgtattcctgttttcccggacagtaatttactgttggctccagcaatcgacaccgttaatagattacctatcctgctctatcagaaccaatttgcagatacgcgcattttggttacgataagcgatcagcatattcgtggggcacttaatgtacccttgaaaggggtaaggtatgtattacgcgtggcggatgacattattggaccaacgggtgatgtgatgacgcttaatggacattatccctataccgagaaggttcactccacaaaatatcatttcactattatctttaacccgccgccactctttagcttctacagacttatcgataaaggctttgggattttaatatttattctgttaatcgcctgcgccgctgccttcctgcttgatagatatttcaataaaagcgcaacgcctgaagagatcctgcgacgggcaataaataatggggagatcgtccctttttaccaacctgtggtaaatggtcgggaagggacattgcggggagttgaggtgttagcccgctggaaacaacctcacggtggatatatatcacccgcggcatttattccacttgctgaaaaatccggattaatcgttccgcttacgcaaagcctgatgaatcaggttgccagacagatgaacgctatcgcgagtaaattgccggaaggttttcatattggaattaattttagcgcttcgcatattatttcgccgacgtttgtcgacgagtgtttaaatttccgtgacagttttacccgccgcgatttaaaccttgttctggaagtcaccgagcgtgagccattgaatgttgatgaaagtctggttcagcggttgaacatactgcatgaaaatggttttgtcatcgcactggatgatttcggtactggctactcagggctttcttatcttcatgacctgcatattgattatatcaaaattgatcacagtttcgttggccgcgtaaacgcagacccagaatcaacccgaattctggattgtgtattggatctggcgcgtaaactttcgatcagtatcgtcgctgaaggtgtcgaaacgaaagaacaacttgactatctgaaccaaaataatatcacatttcagcagggttattatttctataaacctgttacatacatcgacctggtcaaaattatcctttctaaaccgaaggtgaaggttgtggttgagtgaaaattgatcagtaaggccatagtgcggtgtaattatagacagctaattagctcgttgcctcttgttactattgttcattattttgtttgctataattgtttgaaagttttgacaggattgccattagtagcatgaacaatagtaataatctggattatttcactctctatatcatattttccattgcatttatgctgatcaccctcctggtcatccttattgcaaaacccagtaccgggctgggagaagtgcttgtgacgataaatttgcttaatgcccttgtttggctggcgatcaatctggttaatcgattaagagaaagactcgtcaaccacagggatcagcaataatctttcagtttctcactgtcagtatgcggctgaatgggttgctggcagtgaacgcctggatcattgaaggaaaggcattattgcgcaaatagttgtcaaccctggtgttatcacggttgtttttatatatcaccgaaataatcctcattgcaactattaacaattttgatgtcgaagagttatttgttaaacaaaatcgtcacctcaaagtgatcaatgtcatgaaaataaggtgaaaaatgataatgccgacttatttatcatttatatattgtcgctgtttatctatttaaattttttgtgcttttgtttttgtctttaccctccgttttggtaatctgagctcataggttatttgaccaggaatgtttgttaatccaatgaatggatggttaatctatgaaactgaaaaaactctccgggtttagtttgggacttattgctctggcggtgggtaatgcatatgcaacacaattgttggatgattatagtataatttcctatatgactgatgaagaatcgccgattgaaatcaaagataataatccgataagtaatggagagtatctaaccactgaagacgaaagccatgctgtgaaagtggatgacggtgtaactggatatataaataatgccagtgtgatgactagtggtgatggatcttatggtatttctgttgatagtcaaaacaaagtattatatataagcgatagcgatattaagacctctggaagcgtatctgacaaagaaaatggagggataacagccagcgcagtagtcagtgaatttggtggcaccatctttatgaatggtgataattcagtcgagtcgggtggggcatattcagcgggacttttaagccaggttaatgattctgaaaagatggtaaataacacccgtcttgaaaccacagataaaacgaacattgttacctctggggaaaatgcagtaggtgttcttgcatgttcaagtcctggagagtctcgaacatgtgtcgatgctgtagatgatgaagttagtgattctaacagttacgaagttattagccgtgctgatttaaaaatgaatggtggttccataacaactaatggcattaatagctatggtgcttatgctaatgggaaaaaagcatatattaatttagattatgtggcacttgaaactgtggctgatggaagttatgcagttgctattcgacaaggtaacattgatataaaaaatagttctattacaacaacaggcactaaagcccccattgcaaaaatatacaatggtggagagttatttttttccaatgtcaccgcggtatcaaaacaagataaaggaatatcaattgatgcatcaaatatcgattctcaagccaaaatagcactattaagtgttgaactttcaagtgctttggatagtattgatgttaacaaaactacaacggatgtaagtatccttaatcgaagtattatcacacctggtaataatgttctggttaataatactggaggtgacttaaacataatttcgtccgactctattctaaatggagcgactaaactcgtcagcggcacaaccacgctgaagctttcagaaaatacaatctggaatatgaaagatgactccgttgttacccatctgactaattcagacagtattatcaatctttcgtatgatgatggtcaaacatttacccaaggaaaaacattaaccgtaaaaggtaattatgtcggtaataatggtcagcttaatatccgcaccgtattaggtgatgataaatcggctacggacagacttattgttgagggtaatacttcgggttcaactaccgtctatgtgaaaaatgctggaggaagcggcgcggccacgctaaacgggatcgaactcataactgtgaatggcgatgaatctccagcagatgccttcagataaggtgatgcaaggattgcagctggagctttcgaatatcaactaaaacaacaaggcaaaaactggtatttgacaagttatcagtcagtgaatgaggaggataacagctcagagggaaattcagaatcaacagaaacgcctacccccgtcctgcgccccgaagctggaagttacgtcgctaacctggcagctgctaacactctttttgttatgcgtctgaacgaccgtgcgggtgaaacgcgctacatcgatcctgtaactgaacaggagcgttcaagccgactttggctacgtcaaattggcgggcataatgcctggcgtgacagcaacggacagttgagaacgacctcgcatcgctacgtctcgcagttagggggcgatctgttaaccggtggttttaccgatagtgacagttggcgtttgggagtgatggctggttatgcccgcgactacaacttaactcattccagcgtgtcggattatcgttcgaaagggagtgtcagaggctatagcgcagggctgtatgccacctggtttgccgatgacatcagtaaaaaaggcgcatacattgactcctgggcgcaatatagctggtttaaaaactcggtgaaaggggatgaattagcctatgaatcctatagcgcgaaaggtgcaaccgtctcgctggaagcgggttacggttttgccctgaataaatcctttggtctggaagcggcgaaatatacgtggatcttccagccacaggcacaggctatctggatgggcgtcgatcataatgcgcacacggaagccaatggctcacgtattgagaatgacgcaaataacaacatccagacccgactcggcttccgcacctttattcgtactcaggagaaaaacagcggtccgcacggtgacgactttgaaccttttgttgaaatgaactggatccataacagtaaagattttgctgtctcaatgaacggtgtgaaagtcgaacaagatggggcgagtaatttgggggaaattaaacttggcgtaaatggcaacctgaatccagcggccagcgtctggggaatgtgggcgtgcagctgggtgataatggctacaatgacaccgcagtgatggtgggcctgaaatataagttctgatcccgccgttagctaaaaaaccgcgtcgtattcatcgacgcggtacatatgaaatattattttttgccgatagcacgcatggtgtcatcaattgccgtgatcaacagcatttgcgggtctttagcgcaaacctgattcagtttttctaccactttggcgctcagttccggagattgctcaatttttaaatcacggctggcaacgctggcattacccattaccgcaacaatttctgcaacctgtgcgctgtcagtttttgccatttcgttggcttctgcgcaagtaatataggtttctgacggcaaaccgtttttaatattgtagtcctgcgcccaggtcattggtgcgaaaacaaacaggcccgccagtaaagcaaattttttcatcatcattccttatttcattttacccagaattgcaccacccgtaccgccaatcacggcacctttaatcgccccttcgaggccattgccggtcagaacgccagtgacagcaccaacggcggcacccacttttgcacctttacgcgcatttttaccgtcgcggcctttttctgttactgcaccaacaccagcgccaacagctgcacctttcagtacgccattaacaccattgccagtaagtaaaccaacgcctgcgcctagcaatgcacctttcgtggtgcggttcatatccgccatcgctggcgtggagcagaacaatgctgagataagcccgaaggcaagtatttttttcttcaacttagatgtccggtattaagtaagttgcacacacaataatttcgtcttcaattaagatctgcttaactaaagaacgctcgctattattcagataattcaaaatgagcgtggctgtgatgataggaattatgttttttacgtgaatgagaataatcttaaacgaggaataactcattgattgacaatatttttattcaagaagtgtcattgactgttaacgcaatgttgtaaaggtaagataatctgatttatcaatattattgtgtgatttttatgtgagcagaagatattcatcagcaacgattacattagtcattttattttgccgacggcctcattgtcgaaagataagcgtacgacagtattatcagaaaagagtgattttttatccaactacacttcagcgcactgcgtgtaaaaaatgcctctttcttatgcgggatatcatcatttcatcatgatgtctttggtgagcggtgaacacaatacacctgcgctgtctcttcaggatgaatcccctggtctggtgcctgcgggctgatgttgcagcagagcttaggtcacttagacgctactatcatttatccaatggcatggaatcgaaatcagtcgatacccgcagtatatatcgtgaactgggtgcaacgctgagttacaacatgcgcctggggaacggtatggaaatgaaccctggctgaaggcggctgtgcgcaaagaatttgtcgatgataaccgggtgaaggtgaataatgacggtaatttcgtcaatgatttgtcgggcagacgtggaatataccaagcagctattaaagcctcattcagcagtacgtttagcggacatctcggggtggggtatagccatggtgccggtgtggaatccccgtggaacgcggtggctggtgtgaactggtcgttctgaccatcaacgattaaactgcgcttcggcgcagttttcgtttacaggatgttgaaagggaaaattctggggcaaaaaaagcccgccagttacggcgggaaacctcatcctatgggagaacaatgaataatgaaattgcggggttatcatctcccagtatatccatactaacaataaggttatttactcaaccaggcataaacattttgttttgtgcgtgggaacagccttaaggtgtaaagggggaggtggaaatagcaatgaggagtatcagcaagaatactcgccgctttaccacaacgtggatgagagggatgaaaaactcaaggcagagataactctgccttgaagataaatgcgcttttacagcgggcttatttcagctcttctgcttccggtaaggtcacgttcagctcaagaatagaaatatcgccatctttttgctcaagctgtacggttaccatctcaggatcaatttgtacgtatttacaaatgacctcaagaatatctttacgcaactgcggcagataatgcggttctgcatcgctgcgacggcgttcagcaacaataatctgcagccgttcttttgcaatgttggctgtgtttttcttccgcgagagaaagaaatcgagtaatgccataacttatcctccgaacaaacgtttgaggaagcctttcttctcttcttcaatgaagcggaaaggacgttcttctcccaacagacgttctacggtatctgcgtaggctttacccgcatcggcgttaatgtcgagaatgaccggttcaccctggttagaggcgcgcaatactgattgatcctctgggatcacgccgacgagtttgatgcgcaggatctccagcacatcttccatgctcagcatgtcacctctgcttacgcggcctgggttatagcgcgttaacagcaggtgctctttaataggctcttcgccattttctgcgcggcgtgatttcgacgccagaatgcctaaaatacggtcagagtcgcgtactgaggagacttccgggttggtggtaataatggcttcgtctgcaaaatagagtgccattaacgcaccggtttcaatccctgccggggagtcacaaacgataaattcaaaatccatcgctttcagatcatcaagaactttggcgaccccttcacgggtgagggcatctttatcgcgtgtttgcgatgccggcagaatatagagattttcagtacgcttatctttaattaacgcctgatttagcgttgcatcgccctgaatgacgttgacgaaatcgtaaacgacccggcgttcacaacccataatcaggtcgagattacgcaggccgatatcaaaatctatcacgacagttttctttcccttctgggccaaaccagtggcgatggccgcgctggaggttgtcttaccaacaccccctttgcccgaagtaacaacaataatgcgtgccatagaaattccttgttaaaaagggatcaatttaacggttgaacggtcaaagcgttttcgactaactgcagtcgcgccgctttgccataaaattctgctgggatttgatcactcagccagtattcacctgcgatggacaccagttccgccatcaggttcgtacaaaatatttgcgtttcccggtcaccacttgcccctgccagcgcacgaccgcgcatcatgccatagacatgaatgttcccatcggcaatcaattcggccccagcgctaacgtggcttgtaacaatcagatcacattgtggagcataaatacgctgaccggaacgcaccggggtatctattaaacgcgtttttgtgaccggcgttgtattttgcgctggagcctgcggtgtgggagctggacgtggcgctttttcctttccttccgtcaggataggcagccccatcttttcaatttcggctttaagttgcgcatctttgcagccacttacgccaataacccgcaaaccggttgccgaaaccgccttatgcatcgctgaccagtttactgggtcttccagtgcactgacgttgagtacaacgggggcatgttttaaaaatgcgggggcctgagcgattttgtcttccagcgcctgatggataaccttaggttctgcctcatgcagatgaaccacagataaagtgaagctactgcctttaagctcgattggcgtgtttgacatcctggccttactcaattagctattaatcatcgccagcgcgcgatgatgttccgaagactataaggcatgttatagtctggattatattgaggcaagtcaccctcccatttattcagagtaaaagtctattctgtgataaatggcgctgattcatagcttaaaaaatacccttgtcaatcaacccattgccgtcgtacttttgattgttcttatttacgcttcctttttccgcaccctaatcgtgacagcatctccagacctgtttaaatatccagtattgaggcaagtgtattttttcaccacgccaggctttcttaactttccattttttgcggcatcattaaagaacagatacccgttatcttaatatccgccacagaattgctctatcatagaaaccgcagaagacgtctgatacttctgtcaggtcatcgtaactcgtccaggtcagcggttttgattacggattgatgatgaaatgagcataagtgttgtacggttggattatcaggatgtgctatgaatatgatgcgtattttttatatcggattgtcaggtgtggggatgatgttctcatcaatggcgtctggaaatgacgctggcggacttcaatctccggcgtgcggcgttgtttgcgacccgtatatttgtgtgaactcagatggcatttccccagcgttaacaaggaaatatctcggcgaaaaagccgctgaaaacttacaatcattacaaggctacgatcccagcgaatttacattcgctaacggtgtattttgcgatgttaaagaaaaattatgtcgtgatgatcgttattttggtgtggatggtaagcggagtggaaaaatcaatcaaatcaccacaaagatgttatttatgtgtcgtgagtgatgtcttgtttacattatgttctattcgtcattaacctcttgagcgacagagaggagtggggcgtcaacgtttatgacggggagagtccccgtcggttgacatttacttaatttgaatatcgacgttatattttttagttttgtttttacgggcgtcgtttcgggtttgcagcactcgcagctcatatttgccagaagcagggagtgagtattgtccgtgactatcgagttctggggaatatctggataaatcaacagaatcatcgattcctggcccgaagaggtaagtatcagcgccttcattagagatactcacatgcactttctgaccttttttggcatagaaggtatatgtatcgtaatcgtatccctttatttcgccggagtactgagcgctgctatggccttttctgaactcaacattgacattcttacccgcagcaaagctcgtggaggttagcagtgcaaacagcaatacagccttactgatgctcttgattttcattggtagtctcctgttcagaatgagtacgatgaactgttataatataacaatcccttacgggagaattccagtggcttttctgcgttcggtaaaatcccggcgcggcattttttgccggggggattacttataaaggggcatggactcaacaaaccgcagaaatctacagctggctggcttgtggcgcgggtttcattgatgttagcttatgccaaaacctggcatcttaaagagtaaaagtatgttttgtgtgatttatcgaagcagcaagcgtgaccagacctatttatatgtcgaaaaaaaagacgatttttcgcgtgttcctgaggaactgatgaaaggttttggtcagcctcagttagcgatgattctgccgttggatgggcggaagaaactggtcaatgctgatattgaaaaggttaaactggcattaaccgagcaaggttactatttgcagttaccgccaccacccgaagatttgctgaagcaacatctttccgtcatggggcagaaaacagacgacactaacaaataaccgatatccggcggtggcattatctttgtcggcgcgggttttcatatccacgataaggtgaggggaacgttatgtatcaacatcacaactggcaaggtgcgctgctggattatccggtgagtaaagtagtctgtgttggcagtaactatgccaaacatattaaagagatgggcagcgcagtgcccgaagagccagtgctgtttattaaaccagaaacggcactgtgcgatctgcggcagccattggcgatcccatccgatttcggttcagttcatcatgaagtcgaactggcggtgttgattggcgcgacgctgcgtcaggctacggaagagcatgtccgcaaagccattgccggttatggcgtggcgctcgatctgacgttgcgtgatgttcagggaaaaatgaagaaagccgggcagccgtgggaaaaggctaaagcgtttgataactcttgtccgctttccgggtttattcccgcggcggaatttaccggcgacccgcaaaatacaacgctgggcctgagcgtaaacggcgagcaacgccagcaaggtacgactgcggacatgatccataaaatcgttccgctgatcgcttatatgagcaagttttttaccctcaaggccggtgacgttgtgttgacaggcacgcctgatggcgtcggcccgttgcaaagcggtgatgagctgacagtcactttcgatgggcattctttgacaactcgcgttttgtaatactttttgccgcctgaaagcggcggcaaaacttgcatcgctgtgccagactggttataaggtgcgttttaacgtaatggcggaacacctgatgagcgatgtacctttctggcaaagtaaaaccctggacgaaatgagcgatgcggaatgggagtcgttgtgtgatggttgcggtcagtgttgcctgcataaactgatggatgaagacaccgacgaaatctacttcactaacgtcgcctgtcgccagctcaatattaaaacctgtcaatgtcggaactacgaacgtcgtttcgagtttgaacccgactgcattaaattaacccgtgaaaatctgccaacattcgaatggctgccaatgacctgcgcttatcggttgctggcggaaggtaaagatttacctgcgtggcatccgctacttacgggttcgaaagcggcaatgcatggtgaacgtatctctgtgcgtcatatcgcagtgaaagaatcagaagtgattgactggcaggatcatatcttaaataaacctgactgggcgcagtgataaatttaatagatgttgatgggggctttcttaatatacgtctggatgctcgccatttcgtagccctgtttttgaaagcgctctgtcataatgagagttacccgataccttattatcaacaggtaactctcaatctttaaaaaacgtctgtgtttttaaatgtgataaaccttataccttgagtacatggagagaataatagcttatcagacttcaggtacctcaaagagtgtctttttaccgtgtcttttctgatactcattacaggtgttaatcatttttttggccgcttcttttagcaaagaaagcattaaatcatcataatcaacatagaatctggttgtttcagtttccgtttttatctccccgatggcgactatttcggtggttaatttcaatttggcggcatcgatatctttattcgcttgtttaaccgtgtttgacagggtggtaaagaaattctgcacagattttaacttgttcttcaattctggaatcagtttcccttcaactacgcccgcagcaatagaataggaaatgattaatccaaatggaccggcgacgacaccggcatacgcttccttcctgattttatctacctgtgactggaaatagctgtttttttttctgaaaaatcattggttaactggctatctaacgccagcagtttcccggaagcgttgttgaaactttgtgagcttaccagcagggatttttgcgcttcattcagcttcgtgatgccgtcatccagtaccttaatgagaatgtctttctgggcggatgctttcttctcattgtactcatcaaatagcaaaatatacgctgcgagcaattgcgtcgcaacaccacaccattcatacactgtttgggttgcttcaaaatacttatcctggctatccataagtaaggttttaatatcgccgactaaaacggaggctgcctgttaatactcctgtttaaagcgacttaactcttttatggtttcatcaaaggtctgccaggggatgacctgatcgagatatttattataaagatctaatgctccatctgcggtttcgattgcgtttttaactacttctaccgttttatctgcaacgatttcagtcataatcattcgcctctttaaatatataaattgtaatgaaactcctgttttacaactattaataaattttacttcatctaattcatagttagccgggcgggatgcgtcaatgtctttatttctattaatatgataaatatcaaacaatgtttaatgtcattatggcgaatgcttctattctatttttttgccgggtgatatttttcatttctgctggatgagcgtcgtcgccagaaggccacgtgagcacaggataagagaacgaaaaatcagcagtctatgcagcgacaaatattgatagcctgaatcagtattgatctgctggcaagaacaggctactgtatataaaaacagtataacttcaggcagattattatgttgtttatcaagcctgcggatctccgcgaaattgtgacttttccgctatttagcgatcttgttcagtgtggctttccttcaccggcagcagattacgttgaacagcgcatcgatctgaatcaactgttgatccagcatcccagcgcgacttacttcgtcaaagcaagtggtgattctatgattgatggtggaattagtgacggtgatttactgattgtcgatagcgctattaccgccagccatggtgatattgtcatcgctgctgttgacggcgagtttacggtgaaaaaattgcaactacgcccgacggtacagcttattcccatgaacagtgcgtactcgcccattaccatcagtagcgaagatacgctggatgtctttggtgtggtgatccacgtcgttaaggcgatgcgctgatgtttgctctctgtgatgtaaacgcgttttatgccagctgtgagacggtgtttcgccctgatttatggggtaaaccggtggttgtgctatcgaataatgacggttgcgttatcgcccgaaacgctgaggcaaaggcgctgggtgttaaaatgggcgatccctggttcaaacaaaaagatctgtttcgtcgctgtggtgtggtttgctttagcagcaattatgagctttacgcagacatgagcaatcgggtgatgtcgacgctggaagagctatcgccccgcgtcgagatttacagtattgatgaggcattctgcgatctgacaggtgtgcgtaattgtcgcgatctgactgattttggcagagaaattcgcgcaacggtgctacaacgtacccatcttactgttggcgtggggatcgcccagaccaaaacgctggctaagcttgccaatcatgcggcaaaaaaatggcagcggcagacgggtggggtggtggatttatcaaatctggaacgccagcgtaaattaatgtctgctctccccgtggatgacgtctgggggattggacggcggatcagcaaaaaactggacgcgatggggatcaaaaccgttctcgatttggcggatacagatatccggtttatccgtaaacattttaatgtcgtgctcgaaagaacggtgcgtgaactgcgcggcgaaccctgttttcaactggaagagtttgcaccgacgaagcaggaaattatctgttcccgctcgtttggtgaacgcatcacggattatccgtcgatgcggcaggccatttgtagttacgctgcccgggcggcggaaaaacttcgcagcgagcatcaatattgtcggtttatctccacgtttattaagacgtcaccatttgcgctcaatgaaccttattacggcaatagcgcgtcggtaaaactgctgacgcccactcaggacagcagggatatcattaacgctgctacgcgatctctggatgccatctggcaagcgggccatcgttaccaaaaagcgggcgtgatgctgggggatttcttcagtcagggagtcgcgcagctcaatttattcgatgacaacgcaccgcgccccgggagtgagcaattgatgacggtaatggatacactgaatgctaaagagggcagaggaacactctattttgccgggcaggggatccagcaacaatggcagatgaagcgagccatgctttcaccacgttatacaacgcgaagttctgatttactgagggtcaaataaatatagcggcaggaaaaaagcgctcccgcaggagcgccgaatggattagcgaccgaacagatcacgttttttcgctttaaacggctgggaaatcaccaccagcactgcgacaatcaggtaagcgataaaaataccgagcagccactgcggcatttccagacctaaaaaatcccactgacgctcggcgcaatcgccagaggcgacaaacacttgcggcacccacttatccagcggcagccattccgggaaacgaaccataaaatcacaggtggcaaacggcgaaggatagagctgaagcatggtgtgctcgtaagttaactgcacaccgcggaacgcactatacaaccagataaccatcgctacataacgcagcggagttttcggggcgatcgcgccaatcagcgcagcacccagaacgccgaataacgcgcagcgttcataaatacagagcacgcaaggtttcagtaacatcacatgctggaaccacagcgccgtcagttccagtgccagagcagtaaacgccatcaacagccacgcgccccggccttgtgaacattggttcaaaaatcgcaacataatcatttccctgcaatatgcatagagtgcgcagtttaaaccaattcattcgctgcgccaccaggaggcagcaaaaataggacgcaattggacaattatcgggcgaaaaggcaaaccgggcatttatatgcccggtaagttgttatcaaagcgttgctatccagcccatttgcataaaccattcggttacaggggcaagcgtaaactcgacgcagagcaagccgacgagtgtcaggacgagggtgtaaggcagggccatccacaccatgcggccataagagaggcgaatcaatggcgcgagtgcagaggtcagcaggaacaggaacgcagcctgaccgttcggcgtagcgacggagggcagattggtaccggtattaatggcgaccgccagcagctcgtattgcttcaacgtgatagcgccactttccattgccgctttcgcttcgttgatataaatcgtccccacgaagacgttatccgaaatggatgacagcagaccgttgaaaatatagaacagcgacagctgagcatgttccgatgcctgcaacacaaactgaataattggcgaaaacagttgttggtcgataatcaccgcgactaccgagaaaaacaccgtcaacagtgcggtgaatggcagagattcggtgaaggctttaccgatagcatgctcatcggtgacaccggtcaatgatgttgccagaataatgactgacaaaccaatcaagccaacttccgccagatgcaacgccagcgcagtcaccagccagacgccaataatcgcctggacaatcagacggattttatcctgacgggtacgctggtggcggctttgatcgtcaaactgttgcaacacttcgcggactttctccggcagcgtttcaccgtagccaaaccaacgcagcttctctaccagcaggcaggttaacaggccacaaatcagaaccggaacggtcaccggcgacatgcgcaggaagaaatcgccaaaatgccagccagccgctttagcgatgatcaggttctgtggttcgcccaccatggtcattacgccgcctaatgcggtgccgacaccggcatgcatcatcaggctacgcagaaagccacggaactgttccagaaccactttgtaatgcttgtcgatatgactatcgtcttgcaggtcggtgtcttcggtacgggaagaggctacgcggtgataaataccataaaaaccgactgcaacgctgatcaccaccgccacgacggttaaggcatcgaggaacgcggagaggaacgcagccgccacgcaaaaagagagcgacagcagcattttggagcgaatgcttaacagcaaacgggtaaatatgaacagcaacagctgtttcataaaatagatacccgccaccataaacatcagtaacagcaagacttcaagatttgccgccacctcttcacggacgtgttccgcgctggtcatgccgatgaataccgcttcgatagccaacagaccaccggggagcagcgggtagcatttcagggccatcgccagagtgaaaataaattccgctaccagcaaccagcccgcgacgaaagggctgatgaggaaaattaacgggtttacgattaagaaaatgatgagggcgagtttgtaccagtcgggggactggcccaaaaaattgcgccatagcgcgcggccccaggagatctccatgatggtttcccttaccttacaaataatcaatgatgtttttatgtttaaacgcaaagcttaacggtcaggcaggagtgaggcaagtcttgatagtcaaggggaaagagatgcggaaaatgaagccttgatccctttttcttctttttgtctgctatcagcatagttagccctctggtatgatgagtccaactttgttttgctgtgttatggaaatctcactatggtcattaaggcgcaaagcccggcgggtttcgcggaagagtacattattgaaagtatctggaataaccgcttccctcccgggactattttgcccgcagaacgtgaactttcagaattaattggcgtaacgcgtactacgttacgtgaagtgttacagcgtctggcacgagatggctggttgaccattcaacatggcaagccgacgaaggtgaataatttctgggaaacttccggtttaaatatccttgaaacactggcgcgactggatcacgaaagtgtgccgcagcttattgataatttgctgtcggtgcgtaccaatatttccactatttttattcgcaccgcgtttcgtcagcatcccgataaagcgcaggaagtgctggctaccgctaatgaagtggccgatcacgccgatgcctttgccgagctggattacaacatattccgcggcctggcgtttgcttccggcaacccgatttacggtctgattcttaacgggatgaaagggctgtatacgcgtattggtcgtcactatttcgccaatccggaagcgcgcagtctggcgctgggcttctaccacaaactgtcggcgttgtgcagtgaaggcgcgcacgatcaggtgtacgaaacagtgcgtcgctatgggcatgagagtggcgagatttggcaccggatgcagaaaaatctgccgggtgatttagccattcaggggcgataatcccttccgtttaaagagcaaacccctcaaacgaggggttttttgttgtttttacagatttcccattcttggcgggcaacgttccagcaactcgatgctgccgtcttcgttttgctgttcgagcatcacatcaaatccccacaggcgatgcacatgcttcaggacttctttgcgcccccgatccagcggtgcgcgattatgtggaatataacgcagcgtcagcgaacggtcgccgcgcaaatccacgttccagatctgaatattcggctccagattacttaagttatattgcgacgataaccggttacggatctcccgataaccttcttcattatgaatagcggaaatctccagataattatgccgatcgtcatccagcacggtgaagaagcggaaatcacgcatcactttcggtgacaggaactggctgataaaactctcatctttgaaatcacgcatcgcgaaatgcagcgtttccagccagtcggaaccggcgatatccgggaaccagtatttgtcttcttccgttggcgactgacaaatccgtttaatatcctggaacatggcgaacccgagggcatacgggttgatgccgctgtaccacgggctgttataggggggctggaagaccacattggtgtggctgtgcaaaaactccagcataaaacgttccgttactttcccttcatcatacagatggttaaggatggtgtagtgccagaaggtcgcccagccttcgttcatcacctgagtctgtttttgcggataaaaatactggctcaccttacgcacaatacgcaggatttcacgctgccatgattccagcagtggcgcatttttctccataaaatagagcaggttttcttgtggttcggacggatagcggcgcgcttcagcaaccgttttctcttcctcgcgcttcggcagggtacgccagagcatattgacctgactttgcagatactcttcgcgacttttctgccgggctttctcttcttgcagcgagattttttgcgggcgtttgtaccggtccacgccgtagttcatcagcgcgtggcacgagtccagaagccgttctacttcatcaacgccataacgctcttcgcactcggtaatatatttacgggcaaaaatcagataatcgacaatcgaactggcgtcggtccagctacggaataagtaattgtttttaaagaaagagttatgcccatagcaggcatgagccatcaccagcgcttgcatggtaatggtgttctcttccatcaggtaagcgatacacgggttagagttaatgacgatttcataggccagtccttgctgaccgtgcttatacagccgttcagtctcgataaactttttaccgaatgaccagtgcggatagttaattggcatgccgacgctggagtaggcatccatcatctgttctgaggttatcacttcaatctggtgcgggtaggtatccagccggtagagtttcgccacccggtctatctctgccagataaacatccagcaggtcgaacgtccagtcgggtccatcgctcaaacgtgtggtgtccttattcatagaatcgatcgtcgccatacgcgcacctcattgttgtcggcgctctctgtgtggagcacctcatttcaagcatagaacacctgttaaaaaccgcgtcgccggagaatttttttctttgcgatttcttattatcagagtgccactaatccgcttctgaacggaattttatgctggataaaaagggcgttcagcaggagatactaaagacgccatattgccgcagagtcagggagatgtgagccagctcaccataaaaaagccgtatgttgaataatattttcaactgagttatcaagatttgattagattattattcttttactgtatctaccgttatcggagtggctatgcgagttgtcatactgggaagtggtgtggtaggcgttgccagcgcctggtacttaaatcaggcaggacatgaggtcaccgtcattgatcgggagccgggggccgccctggaaaccagtgccgcgaatgccgggcaaatctcccccggatatgctgcaccgtgggcggcaccaggtgtgcctttaaaagcgattaaatggatgttccagcgccatgcgccgctggcggttcgtctcgacggtacgcagttccagttgaaatggatgtggcaaatgttacgtaactgcgacaccagccactacatggaaaacaaagggcggatggtgcgtctggcggaatacagccgtgattgcctgaaagcattgcgcgccgaaaccaatattcagtatgaagggcgtcagggtgggacgctgcaactgttccgtaccgaacaacagtatgaaaatgcgacccgcgatatcgccgtgctggaagatgccggcgtaccgtatcagctgctggaatccagccgcctggcggaagtggagcccgcgctggcagaagtggcgcacaaactgacgggcggcctgcagttacccaatgatgaaaccggagactgtcagctatttacccagaatctggcgcggatggcggagcaggcgggggttaaattccgctttaatacgcccgttgaccaactgctttgcgacggcgagcaaatctacggcgtgaagtgtggcgatgaagtgattaaggccgatgcgtatgtgatggcgtttggttcttactcgacggcgatgctcaaaggcattgttgatattccggtgtatccgctgaaaggctactcgctgaccattccaattgcgcaggaagatggtgcgccggtatccaccattcttgatgaaacctacaaaatcgccattacccgtttcgataaccgcattcgtgttggcggaatggcggagattgttggttttaataccgagctgttgcaaccgcgtcgtgaaacgctggagatggtggttcgcgatctctatccacgcggcggtcatgtcgagcaggcgactttctggactggtctgcgcccgatgacgccagacggcacgccggttgtcgggcgtacacgctttaaaaatctgtggctgaataccggtcacggcacgctcggctggacgatggcttgcggttccggtcagttgttaagcgatctgctctctggtcgcacgccagcgatcccatatgaggatctaagcgtagcgcgctacagccgtggatttacgccatcacgtccgggccatttacatggcgcacacagctaaggaaacgagatgacccgtccgatacaggccagcctcgatctgcaggcattaaaacagaatctgtccattgtccgccaggccgcgacgcacgcgcgcgtctggtcggtggtaaaagcgaacgcttacgggcatggtattgagcgtatctggagcgcgctcggggccaccgatggctttgcattgcttaacctggaagaggcaataacgttacgtgagcgcggctggaaaggaccgatcctgatgctggaaggatttttccatgctcaggatctggagatttatgaccagcaccgcctgaccacctgcgtacacagcaactggcagctcaaagcactgcaaaatgcgcggctaaaagcaccgttggatatttatcttaaagtgaacagtgggatgaatcggttgggcttccagcccgatcgcgtgcttaccgtctggcagcagttgcgggcaatggcgaatgttggcgaaatgaccctgatgtcgcattttgccgaagcggaacatcctgatggaatttccggcgcgatggcgcgtattgagcaggcggcggaggggctggagtgtcggcgttcgttgtccaattcggcggcgactctgtggcacccggaagcgcattttgactgggttcggcctggcattattttgtatggcgcttcgccgtccggtcagtggcgtgatatcgccaataccggattacgtccggtgatgacgctaagcagtgagattattggtgtccagacgctaaaagcgggcgagcgtgtgggctacggcggtcgctatactgcgcgcgatgaacagcgaatcggcattgtcgccgcagggtacgccgacggttatccgcgccacgcgcctaccggtacccctgttttagtggacggcgtgcgcaccatgacggtggggaccgtctcgatggatatgctagcggtcgatttaacgccttgcccgcaggcgggtattggtacgccggttgagctgtggggcaaggagatcaaaattgatgatgtcgccgccgctgccggaacggtgggctatgagttgatgtgcgcgctggcgctacgcgtcccggttgtgacggtgtaacttgttgtaagccggatcggaggcaacgtcttctgggtgcaaaaaaatcatccatccggctggtcagcaactgtagttgttaatgtgacagagccattgcccatgatagtgtccattaaaaggatggacactatttccccggaacctgaactcaccgcacaggcgttctacataaaacgcttacgcttcattgttgactcgaactcgacttcagataaatcacgctttacccttgatggagcctgtacatagatttgtgtaattgcctgattttgatatgttcaattcaacatcaaatgaaggttaaattatggacgacaaacaattgcaggctcaggctgcgttcagcaaagcatcgcaaccggcgatagatgcttcattaaatttaagattcagcttcctcttcagccacccgtacgccaatcttcaacacttcattatcttctttctcggccaccgtccagatcatcccggcaaactctacctggtcaccgacaaccggtgccgcgcctaacaactgctggacaatttcacccagcgtttgctgcttatcacgatattctcgcccgtcttccaggccatatatcagcgcaacatcagcatatttggcgctggcttcgagaatgaagtcaccaaagaagcgttgatccagcgcgaccggcggcgactggctgaacagtttaccgagcgccggaagatcgcgttcccgaccaattacacacaacacatcgccttcgcgcagtcgggtgctgccggtaggatgaagcaactggttatcacgaaacagtgccgcaatacgcgtctcttttggcatatgcaaatcgcgcagtgccgcgcccacgcaccatttatcggcactcaattgataaacaaactgctcccacggattttccggatgaatatccaggccaacgcgtgacaccggacgtcccactggcggaaccaccactttggcttttttagccgcccacgagagtgatgttccctgcaagagcagtgaaaccagaaccacaaagaaggcgacattaaagaacagacgtgcattctccagccccgccatcatcgggaacacggccaggatgattggcaccgcgccgcgtaatcctacccagctgataaacacgcgctcacgcagattgaaaccgcggaaggggagcaatccagcaaataccgaaaggggacgggcgaagaatatcatccatgcggacaaaatgagcgccggaatggcaataggcagcagatcgcttgggttaaccaacagccccagcaccaggaacatggcgatttgcgccagccaggcgaggccgtcgaaattttgcaggatgccgtagcggttgcgaatagggcgattacccagcagaaaaccgcacagatacaccgccagaataccgctaccttccagcgcagtagttaatgagaaaatcagaataccgccacttaatgccagcaatggatataatccggcgggcagggcgatgcggttgatcatttgcagtagtaaataaccgccgccaagacctattacaatgcccagaccaaattgttgcagaatatcgacaatgaacatccagctaatattgctctcatgatgctggatcatcgcaatcagggtaatcgtcagaaagaccgccattggatcattactgccggattcaatttccagcgtcgagccaacacgttcgttaagccccttaccacccagcagagaaaagaccgctgcagcatcggtagagccgacgatagcgccgattaataagccttcaatcaaatcaagattaaacagccacgccgccatcatgccggttaaaccagaggtgataagcacgcccagcgtcgccagcgacagtgccggtcctaacgccacacgaaaggaactggcctgagtgcgcatcccgccgtcgagcaaaataatcgccagtgccaggttacttaccatgtaggcgaaggggtaattatcaaacgggataccgccgacgccatcgactcctgccagcatgccgatcgccagaaaaataaccagaataggaatgccaagacgggaagaaaatgaactaagtaatatactgctggtgacaaggatggatcctaagatgaaaaggctaattattgttgtggcatccaacggtcggttactcctgattacgctgtctcttatataaaccctaccatattagcggcagagacagcgttttacttagccctgaagcgtgatttttttacattttaagaacaggatgaccgctaatcgtcaactgagtgccttcccgggtgttattcagaatggcatgtgcgcccaacggcagcgtaaccgtgcgttgttcatgaccaaaatcgaggccggtaatgagtggaatcgacaggcgggaacgcaaaaacgcgtacactgactccaggttgtaacctgcgtcataatcattgggcgtgctgccgctaaagctaccgagaataatcgccttctgacgtggcaaaattcccgcatgatagagctgcaacagcatacgttcgacccggaaagggtgctcgttaatatcttccagcaccagaataccgttctcaatttttggcatccacggtgtaccgatcagtgaaatcagcatcgcaagattgcctccccacaacgtgccttcggcccgacatgtcgggccttccccttgccattcaatggtgaaggtttcattgcgtaacgccagccagaaatggtgctcggtaaaggcgttcagttcatccgcgccaaagtttgctaccagcatggggccgctaaaggtgatgacattgccatgcgccagaagaccgcactgaatggcggtaaaatcgctatgtccgcaaatgagcaacgggtcatgttgttggcgagccaccagtgcctgccagtcaatatctgccagtaaacgactggcaccgtaaccgccgcgtacagccagcacgatggtgttgggggtagtcagtctggcaagggaattgagatcttccagacgctctgtttccgtacccgcaaaacgctcacaacgacgggcaataacctcgacgttattgacttgatgccccgcgtcggtaaggcgctggataccacgcagcgcggcgtgctgtttaatgcagtaacccgatggggcaattaagtgaaacagagacatggcaattccttgctgacaacagaaacgaaatgtatatcatgccgcttaggtgtgccgttgtcacctcaacggcgattccaggctataaggatagaagaagtgaaattgagatggtttgcctttttgattgtgttattagcgggttgttcatcaaagcatgactatacgaacccgccgtggaacgcgaaagttccggtgcaacgtgcgatgcagtggatgccaataagccagaaagccggtgcagcctggggcgtcgatccacaattgatcacggcgattatcgctatcgaatcgggtggtaatccgaacgcggtgagtaaatcgaatgccattggtttgatgcagttaaaagcttcaacctccggacgtgatgtttatcgccgtatgggctggagtggtgagccgacgaccagcgagctgaaaaatccagagcgtaatatttcaatgggggcggcttacctgaatattctggaaaccggcccgctggcaggcattgaagatccgaaggtactgcaatatgcgctggtggtgtcatacgctaacggggcaggtgcgctgctacggactttctcgtcagatcggaaaaaggcgatcagcaaaatcaacgatttggatgctgacgagttcctcgaacacgtagcgcgaaatcaccctgcgccgcaggctccgcgctatatctacaaacttgagcaggcactggacgcgatgtaaatcagtcgcgcactttgtccgctttttcccgggcttctcgctcgagagagaaaataatccgctgtaattgccgctccaccgtcgggctgacgttaagaaaacggaagctcagacggggagtggtgatggtttcattcttgccatcaatcactttgcgctcgctgatggagattaactgggcgtcaaagtgaaaaacaccccattgcctcatgttgacttcaatctgagcgaagcgcatgccttcttgtaattcggcaggctttgctgtttccagtaatgcgcccatgccgcctaacgacaaatcatacaggcggaaacgtaacgtactgttatccgccagtttggtctggcaaaaataaggcggatggagtggggcggagatgcggaaatatcggcgtcgttgtacaaaccataaggtgggaggcggtacggtgataaatgccggaagctgcaagtattcactctgctgtagttgttcaacagtaaactcgactttcgcaccctgagtttcggcggtaatggtaatgtgctgtgcctttagcacggcgatgttgtcttcggcttgactgccgaaatccagcaccagtttatccggggttattgccagtattttgctgatcagctgcccgccattccaactgagacgcaaaggaattgcggctttgtgcaaatcgcgtaacacgcccaggacggctaacggattttgtttcaggaactgctcatggtaatgactcacgcggaaaaactcctgactgataaactgtctttggtttatcggtcacagttaacaaaacttaatacaaatgcgtgaatattttttacatgttgttcttaaatcagccgacatacgcccagcatcgatcccgcccttgcctatacttagagcgttgacgtaagcatttcttgcgtccgattcatcgaaacgagggcctgaacatgggaattattgcctggattatttttggcctgatagccggcattatcgccaagctaatcatgccggggcgtgatggtggtggatttttcctgacctgtattctcgggatagtcggtgcggtggtcggcggctggctggcgaccatgtttggcattggcggctccatcagtggttttaatctgcacagcttcctggtggcggtggtgggagctattctcgttctgggcatattccgcctcctgcgaagagaataagattttcataaggcggatagcgatacagatgccgctatccgctttcacatcagaacgtatactcgacacctgctttacgggtgaaaaaaatcaatatagcacttcgatatccgataaggtcggttcccggtaacaacaacagaatccttttttaattattgtttcgttgtttttggtgtgattcagaaaataaatattttagacagtagccagtcaggcgttaaaaatggggcggatagtgaggcggttttggctgcgcttattgaacatttagaattgatcaatccttctggcagattaagccaaaatacccgttcggcaatgcttcagttacgcgaagaggaatggtctgaattctttttttggttgctaaattctctggagtgtctggattatgtgattattaatttaactccagaaagcaaaaaaacgttgatgagtgaacaccgtaacaatattcaggtagcaattgatgctttatatagccaacgtcggcgtaaatcgccgggtgatgaaagtgaaacacttacccgtagaaatgacgctatcttcggcaaccacgtatggcaaacatttgcgcaatacttcccgccaggacttgaaaaaccgtctgtgtagaaaaaaccatagctatggtgttatctgccgacaacgccatccggagaagccgaatgacgttgtcggagtaagcgctggttaaggtgtgggttgtgcctctttggttgagggttgcgtcgttgctgacttaacggtcggacgcgtcgccggaacattgtcacacggttgctctttcgggcagatcaaatccagcattttcagcgtcacgccattggtccagccaaagccatcctgtaatggatattcgccaccgccgccccccgttccggtggtgctgacatcatatttttccaccagctttttctcccggtcataggtgtgctgaacattggtcaggaagtgccagctaatgtccatcgccacctctttttgcccgtagttttgtaatccttctgtcgcgacccactgtaacggtgcccagccatttggcgcatcccattgttgcccacttttcaccgacgtggtgttcaggccgccgggttgcagcagatgtgttttcgtcgccgtcgccattttgttggcgcgatctttcgctgccgcattgacgtacagcgggaacagggcggccgcggttaactgattgcgcactttatgacttttcaggtcgtaatcggcataccagccttgttgatcgttccacaggtatttttcgatccctttttgacgggcatttgccagcgtttcgtactggtttgccatcgcgttatctccggcagctttgctggcgcgggcgaggattttttccattttaaacatcaggctgttcagatcgaccggtacgatgctggtggtgcgtaaggtatttaactgctgcgggttgtccatccagcgcgagctgaaatcccagccagacgcagcggcagagcgcaggtcgcggtaaatttcagtggcaggtcgattcggattgcttttggcggtggcaatatcttccacccatgactctggtcgtggcgtatcgcgatcgtcccagtagcggttgagaagggtaccatcctgaagttttacaacgcgtttttcctgttgtccggcttgcaggttttcaacaccgtccatccagtaagcatattctttttgcatttgcggcaggtattgcttcaacgcggcatcgccttcatgctgcgccagtaactctaccatcagggcaaagaagggcggttgcgagcggcttaaatagtaactgcggttgccgttgggaatatgaccgtaagtgtctatttcatgagcaaaattggccaccatatccgcgactttatcccagtgaccgctttcggcaagtcctaacatggtgaagtaactgtcccagtaatatacctcgcgaaaacgtccgcccggcacgacataaggttccggcagcggtaacagagaatcccatttttcggtgttttcggtagaacgcgttaataccggccaaagtccgtcaatatgttcgcgcagtgactgtccctctggcggaacatatttctcgccctctttcggcagggtgaaattgacgttaacgaaatggcgcagatcaaatccgctctggttttgctgcatccgataatcagcaaggatcatcagcggatcgctgttcggcacggcatcggcaaaggttttttggtccggaaaaagtttggcgttttgcacatcattaaacagcggccctaataaaatatcaggcggctgtggtgttaccggtgtttcttctgcctgcaccgatagcgcagcgaaacacaaaaagatgcaggctggaattaacgccattttttgcgggcgagaaggtgcgggggatttcatcaatcattctcctttggcgaaaccgaataaaacggtattcaagtatcagaaaaccttagttcaggatcgcactagctgcatgatcgaaatctcattctgcgaactgtcaggcattttagaaaagggaattaaagggataaataacggcgaaatagagtgatcaaataacgtctgtttattagccagccagcggcgttgggttcgtgattagcgaagaaaaatcatcataaattggtgaaaaatataacaggtatttaaaaatcattagtgctgggtaaattgccggatgacatcagaacgatgccatccgaacggtggcttaaccctgacggttgaaacgttgcgttttaacgtccagcgttagcgtttcttctggttgtatcgcatacagtttctcaccctgctggcaaatccagccaatccccagttcacgggcgattagggcgctgtgggataccggacttccggcgctaaggcagataccttttacaaccgccggatccagttgcagtactgtggaaggataaatgttctccgccagtagaatagttggcgagttaaactgcgggagttcttctttcgtttgggtcaggtggaccagggtgcgatgcagaagatcgtccacatcaatatagcgagcttgtagatattcatcatccagttgctggtattgctggctaagttctttaagaacttgctgccaggcatattctgccgtgcaatgttcatgctgaaggagttcgcttgccgccgccagcagttccggatcatctaacagtgtatggtgaccagaaaagattgcggcaatatcgtcaagcccgctggcttctgctttcgctgttaacgtcatcagatctaataacgtgaagtcaatagcctggcgtaatcgttcttgttcttcttccacggtcagggttgattttgcctgtaccgtacataaaactggttgataataaaaggctttacccgaaacaggcggaacgggacgcagagtaggtggagcgacttcctccgtttcaccaaagttatcttcagccagctgacggaaagcgatcagtgcctcttcagcttctggccctttcgcaatcaggcgcagcgtatcgttatagcgaacttgtagtaacgcaatctggttaatactctctggtgtgacgcatttgccgtttttttccagcaacatatcggcattaaatgtcgataaggtataaaccagccgggaggccggacgtacatgcaggccgttacggttttttatgaccaccgccagagaacgggcttcttcatcgtacgcaggacatgtgtcagagatttcagtgtcggaggacggtaaacccagttgttcacgtttggcttccagcgcatgcatagcgtcaaagataactttgtcgatatccgctcccgaggccgcgctgaccgttgctgccagtgtaccttcgaccaacggcgcagcacacaaacgtacttttgcggcgatctcgggagccagcaattccagcgcagtttcagcactcaataatgcgctacccatatccatcatgaccagcacatggtcggcatcagcaacagattcgatggcctccatcactttgacggcatcggtaccaatgggattttgtggatcgtcaattcccgcggcaatggcgattttacaactatcactcattaacatctgacgggctaattcaccgacaccttctcccagtcggctgctatgtgaaactatgaccaggtttaccatcaccaattccttactcttttgcggctaacgccaacatttgcatcataaacatcaccgaggtcgcgccgggatcctggtgaccaatactgcgttcaccgagataactggcgcggcctttgcgggcttgcatcgtaatcgtactttgtgcagcggattcggcgatgctactggcagcttcgagcgccgccggaacagagagattttgctcgctggactgacgtaacgattccaccaccggcacccacacatcacacatggttttatcgccaggttcggctttcccgcgactgattacgccgtccgcgccatcgcggaacatctgataaagctcttccagcgtcaggctttgccgtgcctgggtcgcctgtgcggcgcggataaagaaggtaccgaacagcggaccactggcaccaccgacgctggaaagcagcgtcataccggtattcttgagaatgaaaccgatatctttatctgcgatagcagggagtttttccactactttgctaaagcctcggttcatatttagcccgtggtcagcatcgccaatttcgcgatccagtccggtaagatactcgctctcggtgctgaaaatatcgccacaacgagtgagccagttaacaatttgagttctgctcagtgacattgctttctccttatttaccccagttaagggccggggtgtggaccggggcgtcccagagtgccagcgtttcgtcatcaactttcagtaaggtgattgagaaaccggtcatatccagtgaggtgcagtacgcgccaattaaattacgttcgatagtcaatcccgcttgctggcaacgtgtggtcaggcggttatagacgccgtacagctcagaaagcggagttgcgccaagattgttaaccagcgcaatcacccgatcgccagactggagcggttgtttggtttgttgttcttcctgccaactgccttgttgataatcccagaaacgcaaagtgcgatggtatgagccatttaccagcagggtgtcgaacatttcatcgacggtttgatcaagggaagagaaggggcggcggtcaatacccggctcaccatgaatgccgacgccaaactccatctcattatccgccagggtaaaagaaggtttgcccgcggcaggaacggtacaggcaccgagagcgatacctattgagtggccttgattattcaacttacgccccagttccgcacaggcgtccagtgagtcgccacgctccgccgcagcgcctacgagtttttcaattaatacggtgttggcaacgccgcgccgcccggcggtataaagactgtcttttactgcaacgtcgtcatcaatgaccacagtggtcacttttacgccgctatcgtgcagtaactcggtcgctgtttcaaagttaagaatatcgccggtgtaatttttgataatcaacagtacaccttcgccgccatcaacttgcatggcgcattcaaagattttatcgggcgtcggtgaggtgaaaatttcgcccggacaggcccccgaaagcatcccctgaccgatataaccacagtgcatcggctcgtgtccgctaccgccacccgacagcagggcgacttttcctgtaacgggggcatcagctcgggtgacatacaccggatcctgatgcagtgtcagcgatggatgcgctttcgccagtcctgccagttgttcgtccagtacgtcttgcacatcattgatcaattttttcattattttgctccagcgattacggtagggcatggatgatgttcaacgacacggcgaccactgactgccgatgaatccattgtgcatcaggcaagggaaaagaaaattagcccaaattatgtttcatagtgaaacatatgctttaatgaatgttccatattgaaacttttacgtgtattaatacttaaaattgcgagccggaacaccttttgtcataagggatgcgggatatgagtggcgcttttaacaacgatggtcggggcatatctcccttaattgcaacctcctgggagcgatgcaataagctgatgaaacgggagacatggaacgtaccacatcaggcccagggcgtgacatttgcttctatttatcggcgtaagaaagcgatgctgacgctcgggcaggctgcgctggaagatgcctgggaatatatggcaccgcgagagtgtgcgctgtttatcctcgatgaaaccgcctgcattctcagccgtaatggcgatccgcaaaccttgcagcagctaagtgcactgggattcaatgacggcacgtattgcgccgagggaattattggtacttgtgcgctatcgttagcggctatctctggtcaggccgtgaaaacgatggccgatcaacatttcaaacaggcactctggaactgggccttttgtgcaacgccgttgtttgacagcaagggccgattgacgggaacaatagcgctggcgtgtccggttgagcaaactaccgcagctgatttgccgttgacgttggcaatcgcccgcgaggtcggaaatttactgctgacggacagtttgctcgctgaaactaaccgtcatttaaatcaacttaatgccctgttagaaagtatggatgatggcgtgattagctgggatgagcagggtaatttgcaatttattaatgcccaggcggcgcgggtcttgcgccttgacgcgacggcaagtcagggacgggcaatcactgaactcttaacgttacccgccgtattgcaacaagcaataaaacaggcacatccgctcaaacacgtagaagcaacctttgaaagccagcaccagtttattgatgcggtgataacccttaaaccgataatagaaacgcagggaaccagctttattttgttgctccatcctgtggaacagatgcggcagttaatgaccagtcaattaggaaaagtcagccataccttcgctcatatgccacaggacgatccgcaaacccgccgcttgattcattttggtcgccaggcggcgcgcagtagctttcctgtcctgctttgtggagaagagggcgtgggcaaggcactgctaagtcaggcaattcataatgaaagcgagcgtgctgcaggtccttatatcgccgtcaattgtgagttatatggtgatgctgcgctggcggaagaatttattggtggcgatcgcacggacaatgaaaatggccgtctgagtcggctggaactggcacacggcggcacgctgtttcttgaaaagattgaatatctggcggtggagttacagtctgctttgcttcaggttatcaagcagggggttatcacgcgactggatgcgcggcgtttaataccaattgatgtcaaagtgattgccacaacgaccgcggacctcgcaatgctggtggaacaaaatcgttttagtcgccagctgtattacgcgctgcatgcatttgaaattaccatcccgcctctgcgtatgcggcgtggcagcattccggcgctggtgaataacaaattacgcagtcttgaaaaacgcttctctacgcggctgaaaattgatgacgatgccctcgctcgcctggtttcttgtgcatggccaggcaacgattttgaactttacagcgtcatcgagaatcttgctctgagtagtgataacgggcgcattcgcgtcagtgatttgccggaacatctgtttaccgagcaggcgacagatgatgtcagcgccacccgcctttccaccagtctgtcatttgcggaagttgaaaaagaggcaattattaacgcagcccaggtcacaggcggtcgcattcaggaaatgtcggctttacttgggatcggccgcactacgctgtggcggaaaatgaagcaacatggcattgatgcagggcagtttaagcgccgggtatgaaagacagaaacgatttctgatacatcagagtgatctgtatttcattccggcgcacgctaacaattttcagcatcgtttaagggcttgtctatcccgcacttaaaagctgaagcgatatcctccgttgacttgcttctgatcaaagaggttaccctgcgtgtaatccgcttcgagatagaatgtgtgctgtttgttatactgtgcactgactcccacgccgttattccagccattacctttgaaactgtacttctcccgggagttgttcaacagatattcggtatcccctgaaaactcgcggatagcgccagtcttcacatagacattcagctggctgttgcctgcggtgatgtcataccccagtatcatgctggcacgccccagcagcgattcgtagtgattcagatgtatattgaggccattactcgccttcatagtcatctcattctggtggctgtatgtaagctgggtttgcggctctatatagaacccataaccagtaggggacaggttgaacctctgcccggcttccagggagatgctcattccattcgcagtgccgttggcgttaacgccgttgttctgactgtccagtacgtggaaactatttttctggcgcgatgcttttataacgagatcgctgtaaaaaccgttttgtgccatgtaactggcgtacattcccatgtagtctgaacgtgcggtaccgtcgcctccgctatagtccggcgatgcatgtgttgagccaatatacagaccgacatacaacggcattacatcagagagacgtttatccccaccaaactggataccgctgtaacccatgtcaaagccgctcagtttgccactggcaaaggagtccaggcttcccccataactgcgcaaccagatattaccgtctttactctgatttcgcaggtcacccatccgttgcatcagcgtacggttttcaacatagttcaataagtaaccgacattgagataattgccgccagcatctgcggtcgtggtgggtttaggcgtgggagcgggttcaggcgtaggatcggggttgactatgggaggctgagcgggagctggtgtgggttcaggattaggagtcggttccggaactgtcccggaagcgtaaagctcccagttagtgccatttttacgcacatcgtacagatatccccccaactcaacctgagaagacgcgctgaacgaggccgcgccgtcagtggtttttaccactgtcagaacttcatttcccgttgtggcctcgctgccctggttgcggatagccaatacgtgattaccagcactactcccgctgatattcaataaatcccctttattattaacgccattaccctcgccaacaacatcagcacgcataataaaggtactgttaccgctcaggttctctacgtttaatgtggcaaatgtgccggcagttgacccgtggctggcaaaatcgacagttgaatggctcagcgccagcgtgtcgagattagaattacttgttacgttccagacgctgttattcattgcaacgtccagttttccgccattgacattatcgctgagggaggaacctgtccaaaccgacccagggtgcatatccagattgattagcccacctttggaaagaacgctaccgttgataagcatacgacccgaggcgttgatgcggctggcggcataaccatcgtcatgttgcgttgcgatggccatctggtcgggtgtactcatatcaatgaccagatcgctcgtgaggtcgatctggctgttggtcatggcataaattcccctggctcctgccgcgccggtgatagccaaactgtctccggttattctaccgccgctgagagcccacaaacccagcgccagactgccattacgatcaactgtaatatcggtattttgcatgttgacaacagacgttgccgtctgggccgaggcaccataagaaccgccggaaaagatgctgtttcgttgcgctgccgtgccagtaaaattgattatcgcgtctgaaccactggtgacgaggccaccgccctgcgcggaagaaatatggctatctgcaccgatagtggttgtaccaccacgaacttcgacgccattggccgcggctccagttacatcaacagtgagtgcattcgcgctaacctggccaaagctccagaggccgtgagcattatcgccattggttttaatggtactgtttgttccgagatcgacaacagagtttttctgtacgtttatccccatggcgctgtagccctgaacatcgattgtcaggtctgtagccgtaaaacgcgcagcaccattggcgttattgccgttgagaccaccgatataaacacctgtacttccatcggtcgtgattttacttccgcttccaagatcgacactggtgccatagtcattgatggttaggcctataccgttcgagttttcaatggtgaattgagtggctgttagtgttgagctatgcccaataatgatgccgtcatcgttactcttaatggtgctgcctgtgcctaagtcagcatgggtatagtcaccaattaagttaatgccgatggcagaggtttgaccaacaacatctactgtgagtcggttagctgtcagggagctatttttgccctgaataatgattccttttgcatatccagaggcgtcgttgacattgacggtgacatcattacccaggttgatattgccaggcgtgtttcctgctggggtcattacactatagaggtttcctgatggatcggcggtatctcctgtaattctgtcaccatcattaatagtaatattggtgccatattgacttcctgtatcagcagctatcagcaggggggaaaatataattgcattcaaaccaatagcgccaaattttatcagttgaattgagggcgaacggatttttaattcagcgagacgatctgctttggtattcccattgtgttgtttgatgcccataccactcctatatagtacccagactatgggtctatggattttgtcattttgtttaaatcaatgaataatatcctcttatcatcatgatatttgtatggtgcaatcatgatgagcttctcagagaataattctctattaccgggcaaaatcaggaatacaggaattaatatatatttaacatcccccttacaaaggtgagtttatatcgagttattccctaagttgtcgttacttattccaattcgttactataaatatggcaaaaatattacaacaaacagcggttaaaaaatttggtgaagattttttgtaataatcctaattagttatgggaatttcgcttgatgtatctgcataacaaaaacaatatgcgccatttttgcattactaataagaaaaagcaaaaaacatcgatattcatttttggtcaatgggttttctggcctatcgttgttattgtgctactggttatcattttcatcttgccagcatattggagcgtgatcaattttgatcagctgtgaagggggctgatgtgtagtgatacaaaaacttacgttatatcactgctaatgagatatccgtcatctgaacacttatgtctttaattattctcgtggttcactataggcaataagcacaaaagtgtaggatgttacaagaatgattaggactcggtgaaatgaaaaatccacgcaattgcgtggattttatatacttttgcgctcttcatgagatttagcgaaacctcatgagacaataaattaattagacgttgaaaaggaagttcatcacatcgccatctttcacgatgtaatctttaccttctgcacgcattttgcctgcttctttcgcgccttgttcacctttgtaagtgatgaaatcttcaaacgagatggtttgtgcacggataaagcctttttcaaaatcagtatggattttgcccgctgcctgcggcgcggttgctccaaccggaatggtccatgcacgcacttctttcaccccagcggtgaagtaagtttgcaggttcagcagtttataaccggcacggatcacacggttcaggcccggctcttccagcccaagctcctgcataaactcgtcacgttcttcgtcgtccagttcggcaatgtctgcttcaacagcagcacaaaccggaaccacaacagaaccttctttcgccgcgatttcacgcacctggtcaagatatgggttgttttcaaaaccgtcttcgttgacgttggcgatgtacattgttggtttcagcgtcaggaagctcaggtaacgaatagccgctttctcttcagcgcttaaatccagcgcgcgcagcatacctgcattttccaactggggcaggcatttttccaggaccgccagctcagctttcgcgtctttatcgccacctttggctttcttctgtacgcgatgaatcgcacgttcgcaggtgtcgaggtctgccagcgccagttcggtgttgataacttcaatatcgtcagccgggttaactttgccggaaacgtgaatgatgttgtcattttcaaagcagcgaacaacgtgaccgatcgcttcggtttcacggatgttggtcaggaactggttacccagaccttcgcctttcgatgcgccttttaccagaccggcgatatcgacaaattccatggtcgtgggaagcgtacgctgcggttttacgatttcagccagttgatccaggcgaggatcaggcattggtacgacgcctgtgttcggctcaatggtgcagaatggaaagttggccgcttcaataccggctttggtcagcgcgttgaacagggtagatttcccgacgttgggcaaaccgacgataccgcatttgaatcccatgatttaaatcaccttaatatcttaataatcaacctgttattgctaacagattgcagaaatggaaataactttgcctattatacacggcactcggcaaaaatgccgcagacaacgacttattgcgctttaaaggcgtgcaatcggttcgttgctttggtcaagccatctgtaaaccacatttcagtacaacgcgccgcttcgtcaatggcttcatcaattaacttctgttcactaacaggcggtttgcctaacacaaaaccgacaactttatttttatcgcccggatgaccgattccgatgcgtaaacggtgaaagttagggttattacccaatttactgatgatgtctttcagtccattgtgaccaccatggccaccgcccaatttaaatttggcgacgccaggaggcagatccagttcgtcgtgggccaccagaatttcgtccggattaatgcggaaaaaactggccatcgccgcaacggctttgccgctgagattcataaatgtagtcgggactaacaggcggacatcttcgcctccaagagtgactcgcgaagtataaccaaagaatttagcctcttcgcgcagcggagcgcgcaaacgctctgccagtaagtcaacgaaccaggcaccagcattatgtcgcgttgcggcgtattcagcaccggggttcgccaggccgacaatcaatttaatcgtcacgtttttttgtcctgagtgtgtacataactggcgcgtagtttactggttgcggccctgcttgacaaaaaactgcgtatcaaatgcagataacgtaataattgcctgagtggactattagaaagtcaaggtgttcaggcgtttatttgtaaagttttgttgaaataagggttgtaattgtgatcacgcccgcacataacccactgggtgttgtctatactttacacataaggaagaggggtattccctgttacaacccagaaagttccggaggtgacatatgaaacgcaaaaacgcttcgttactcggtaacgtgctcatggggttgggtctggtggtaatggtggtcggcgtggggtattcaatcctcaaccagttaccacagtttaatatgccccagtatttcgcacatggtgcagtgctaagtattttcgtcggtgccattctctggctggcgggtgcccgtgttggcgggcatgaacaggtgtgcgaccgttactggtgggttcgtcactatgacaaacgttgccgccgtagcgataatcgccgtcatagctaacaaataatgcagtttgctgaccagtcagtttgcgctgactggtcaatctcgtacttataaatccgccatcgccgcgcgacgattcgggaagaacgcgaggcgtcccgggatcggttgaatgcctgcgcgagccatagtgcgcagtggctggaattccacgttgcacacgcgcagttcacatccttcgggcagacgcttcacaaaacgctggaacgcatcaagaccaccagcatcaagtaccggaacggcatcccacttcagaatcacaatccgtttgccttcaagacgtgactccaggtccgtgaacaagccttcagcagcagcaaaaaacagcgggccaataacgcgcagtaccagaacatcgtctggaacatctacgactaccggtgccaggcgagtcatacgtgcgatacgacgcataaacagcagcgatgccagcacgatccccacgctgatggcaataaccatatcaaacagcacggtcagcgacatgcacagcagcatgacaatgatgtcatctttcggtgcatgacgcagcaagtcgaccactttatgcgcttcactcatgttccacgccaccatcaacagcagggctgccatagcggaaagcggcagccaggagagcagcggtgccagtaccagcagggcaagaataaccagaatagagtggatcaccgccgagataggggaagttgccccggcacggacgttagcggcagaacgcgcgatggcagctgtagcggtaataccaccaaagaacggagcgataatattccccagtccctgtccaaccagttcgctgttcgccttgtgtttcgtcccggtcataccatccagtaccacggcgcagagcagagattcgattgcgccgagcattgccattgagaatgccgcaggcagcagtgtgcgaatagaatcccaggttagcgtgaattctgaattaggcagatcccacggcagcaccagttgcggcagcagttgcggaataccgttaccctgagaaccatcggccaggacgtagtggaattgcgaaccgatggtagcaacatgtccgccgagcaggttaacaatccccatcaccgcgcaaccagccagcaaggccggaaggtgaccgggtaaacgaatgcccagacgcggccaaaaaacaagaatacctagcgtcacaatgccaatggcagcatcacccacattaatggtcggcagcgccataaataatgcgccgactttttgtagataatgttccgggacatgggccatttgcagaccgagaaaatctttaatctgcatggtaccgatggtgatcccgatacccgaggtgaaacctaaggtgacggaaaccggaatatactcaatcaggcgaccaaagcgtgccagacccatcagaatcaaaaagatccccgacagcaaggtcgcaaccagcagtcctgccagtccaaactgttgcgacacgggatagagaattaccacaaatgccgcagtcggaccggaaacgctaaagcgtgacccacccgtcagagcaatgacaatccccgcaacagctgcggtatataaaccgtactggggtgccacaccactaccaatagccaacgccatcgccagcgggatagcaataatcccgacggttatcccggcaatcaggtcacgggtaaaccgtgcggcagtatatttttctttccagcaagcgtcgatcagagcgcggaaaggcatcacatgtgaggaaaatattttgttcacaataatgtttcatccgtgagcgcatcatctgtcaactaaatggcaggtgaaggaggcataggtcatacaaatggatattacagacaaaaaaacccgccgcagcgggtctttgagccgggttcgattagtgttcgaacatggcagagatcgattcttcgttgctgatacgacgaatcgcttcggccagcatacctgacagggtcagagtacgcacgttcggcagtgatttgatttcatcgctcagcggaatggtatcgcagacaacgacttcatcaattacagagttacgcaggttgttcgccgcgttgccagagaagatcgggtgagtcgcgtacgcaaatacacgtttagcaccacgttctttcagagcttcagcagctttacacagcgtaccgccagtgtcgatcatatcatcgaccagtacgcagtcacgacctgcaacgtcaccgatgatatgcatcacctgtgaaacgttcgcacgcggacgacgtttgtcgatgattgccatatcggtatcgttcagcagcttagcgatagcgcgggcacgcacaacgccgccgatgtccggagaaaccacaattgggttatccagattcagctgcagcatgtcttccagcaggatcgggctaccaaatacgttatcaaccggaacgtcgaagaaaccctgaatctgttcagcgtgcagatccactgtcagcacacggtcaacaccgacgctggagaggaagtctgcaaccactttcgcagtgattggtacacgagcggaacggacgcgacggtcctggcgcgcatagccaaagtaggggataacagcggtgatacgacctgcggaagcacgacgcagggcatcaaccataacgactaattccatcaggttgtcgttagtaggggcacaagtggactggatgatgaaaatatcaccaccgcgtacattttcattaatttgtacgctgacttcgccatcgctaaagcgacctacagcggcgtcgccgagtgaagtgtacaggcggttggcaatacgttgtgctagttccggggtggcgttaccagcaaaaagcttcatatcaggcacgagaagaacctcaggcatgcgtccattggtggaaagaatctgccgaaaactgtgcgggccaggcatgatcctttccaggcggtgtattaaagagcgcgatgcaacgtctggaacaaggtgacgttgtcaccgaaactcagcttgcccggcttaaagcatggctctgtgcaatggggaaagattaacgcctttcgccacaaagccattgagccattccggggcttgctctagcacctggcgggcttcagactctgtatcaaattcagcaaagacacaggcccctgtcccagtcaggcgcgacggggcgtattctaacagccaggaaagcaccgcatcaacctcgcgaaaacgttttcttgcgataacctcgcaatcattgctgaattcacattttagcaacgtttctattgacctttttggcgtattgcgcgggagttcaggatctttaaaaatcaccggagtcggaatacttacaccagggtgcgccaccagataccacttctctggcggatccaccggcgttagtatttcaccaacgccttcggcaaacgcggcatgcccccgaacaaagacaggaacatctgcgcccagcgtcagccccatttccgccagctcatccatgcttagcccgcattgccagagatgatttaatgccaccaggaccgtcgcggcattggatgaaccaccgccgagaccgccgcccatcggcaaacgcttatcaatgctgatatccgcaccgcttcccgtcggaagacgcccgctgtctgccgcagttttcatcaacaaccgcgctgcgcgaacgatcaggttatcttcatgttccacgccttcaacgggcgttaacagacgaatatccccatcgtcacgaagctcaatgctgatggtgtcgccgtaatcaagaaactgaaacagcgtttgcagcgtgtggtaaccatccgcacgctgaccggtaatgtataaaaacagattaagttttgccggagagggccactgtgtccgcattatttcactatccagttatccatttttaacttgatgcgttgaccaccgtcggtgagttccatattggctggcatcgcaggttgcgttttggtgtcataaccaccataaacaaccttccagtttttgccattctggctgtaggtaatttcgctcaggcggtactggtcgtccagtttgtagtcggttgcatcacccggtaaacctaaaatccactggcgcaagctgttgagcggaattggcattccggtcaatttgccaatcatctcttcggcgtcatcggcggtataacgctgacctttattgtcgactaactgcacgttacccggttgagcattcagctccagttccgtgctgcccaatgggttagtaagcagcagacggtagcgatcctggccggtttgctgccagaaaaagcgggcgtacactttttgttggtcagaaatataagcgaacgcgccgcgagtctgatactgattaagattgcgcacgtcttgctgatgctgacgccattgtggcgaatccgggcttttgccaggacctttgggcgtggtaacggaacaggcagtgagcacaagagcagccagcggtagcaggcggataagacgaaaatcgggcaggggcatagtgatgacaagtccttgagatacgttgcagttataacccttaatgctagcgttaccgtccgctatcgtctatgttcaagttgtcttaattgccagaatctaacggctttcggcaattactccaaaagggggcgctctcttttattgatcttacgcatcctgtatgatgcaagcagactaaccctatcaacgttggtattatttcccgcagacatgacccttttagcactcggtatcaaccataaaacggcacctgtatcgctgcgagaacgtgtatcgttttcgccggataagctcgatcaggcgcttgacagcctgcttgcgcagccgatggtgcagggcggcgtggtgctgtcgacgtgcaaccgcacggaactttatcttagcgttgaagagcaggataacctgcaagaggcgttaatccgctggctttgcgattatcacaatcttaatgaagaagatctgcgtaaaagcctctactggcatcaggataacgacgcggttagccatttaatgcgtgttgccagcggcctggattcattggttcttggggagccgcagatcctcggtcaggttaaaaaagcgtttgccgattcgcaaaaaggccatatgaaggccagcgaactggaacgcatgttccagaaatctttctctgtagcgaaacgcgttcgcactgaaacagatatcggtgccagcgctgtgtctgtcgcttttgcggcttgtacgctggcgcggcagatctttgaatcgctctctacggtcacagtgttgctggtaggcgcgggcgaaaccatcgagctggtagcgcgtcatctgcgcgaacataaagtacagaagatgattatcgccaaccgcactcgcgaacgtgcccaaatactggcagatgaagttggcgcggaagtgattgccctgagtgagatcgacgaacgtctgcgcgaagccgatatcatcatcagttccaccgccagcccgttaccgattatcgggaaaggcatggtggagcgcgcattaaaaagccgtcgcaaccaaccaatgctgttggtggatattgccgttccgcgcgatgttgagccggaagttggcaaactggcgaatgcttatctttatagcgtggacgatctgcaaagcatcatttcgcacaacctggcgcagcgtaaagccgcagcggttgaggcggaaactattgtcgctcaggaaaccagcgaatttatggcgtggctgcgagcacaaagcgccagcgaaaccattcgcgagtatcgcagccaggcagagcaagttcgcgatgagttaaccgccaaagcgttagcggcccttgagcagggcggcgacgcgcaagccattatgcaggatctggcatggaaactgactaaccgcttgatccatgcgccaacgaaatcacttcaacaggccgcccgtgacggggataacgaacgcctgaatattctgcgcgacagcctcgggctggagtagcagtacatcattttctttttttacagggtgcatttacgcctatgaagccttctatcgttgccaaactggaagccctgcatgaacgccatgaagaagttcaggcgttgctgggtgacgcgcaaactatcgccgaccaggaacgttttcgcgcattatcacgcgaatatgcgcagttaagtgatgtttcgcgctgttttaccgactggcaacaggttcaggaagatatcgaaaccgcacagatgatgctcgatgatcctgaaatgcgtgagatggcgcaggatgaactgcgcgaagctaaagaaaaaagcgagcaactggaacagcaattacaggttctgttactgccaaaagatcctgatgacgaacgtaacgccttcctcgaagtccgagccggaaccggcggcgacgaagcggcgctgttcgcgggcgatctgttccgtatgtacagccgttatgccgaagcccgccgctggcgggtagaaatcatgagcgccagcgagggtgaacatggtggttataaagagatcatcgccaaaattagcggtgatggtgtgtatggtcgtctgaaatttgaatccggcggtcatcgcgtgcaacgtgttcctgctacggaatcgcagggtcgtattcatacttctgcttgtaccgttgcggtaatgccagaactgcctgacgcagaactgccggacatcaacccagcagatttacgcattgatactttccgctcgtcaggggcgggtggtcagcacgttaacaccaccgattcggcaattcgtattactcacttgccgaccgggattgttgttgaatgtcaggacgaacgttcacaacataaaaacaaagctaaagcactttctgttctcggtgctcgcatccacgctgctgaaatggcaaaacgccaacaggccgaagcgtctacccgtcgtaacctgctggggagtggcgatcgcagcgaccgtaaccgtacttacaacttcccgcaggggcgcgttaccgatcaccgcatcaacctgacgctctaccgcctggatgaagtgatggaaggtaagctggatatgctgattgaaccgattatccaggaacatcaggccgaccaactggcggcgttgtccgagcaggaataatggaatatcaacactggttacgtgaagcaataagccaacttcaggcgagcgaaagcccgcggcgtgatgctgaaatcctgctggagcatgttaccggcagagggcgtacttttattctcgcctttggtgaaacgcagctgactgacgaacaatgtcagcaacttgatgcgctactgacacgtcgtcgcgatggtgaacccattgctcatttaaccggggtgcgagaattctggtcgttgccgttatttgtttcgccagcgaccttaattccgcgcccggatacggagtgtctggtggagcaggcactggcgcggttgcctgaacaaccttgccgtattctcgatctcgggacgggtaccggggcgattgcgcttgcgctggctagcgagcgcccggactgcgaaattatcgctgtagatcgtatgcctgatgctgtctccctggcacaacgtaatgcccagcatctggcgatcaaaaatatccacattctgcaaagcgactggtttagcgcgctagccgggcagcagtttgcgatgattgtcagcaatccgccgtatattgacgagcaggaccctcatcttcaacaaggcgatgtccgctttgagccgctcactgcgctggttgcggcagacagtggaatggcagacatcgtgcatatcatcgaacagtcgcgtaacgcgctggtatccggcggctttctgcttctggaacatggctggcagcagggcgaagcggtgcgacaagcatttatcctcgcggggtatcatgacgtcgaaacctgccgtgactatggtgataacgagcgcgtaacgctcggccgctattatcaatgacaagtttttctacactgcttagtgttcatcttattagtatcgcgctttctgttgggctattaaccttacgtttctggctacgttatcagaagcatccacaggcatttgctcgctggacgcgcattgtgccgccggttgtcgatacgctgttactgttaagcggcattgcgttgatggctaaagcgcacatcctgccattttccgggcaggcacagtggctgactgaaaagctgtttggagttatcatttatatcgttttgggttttattgcactcgattatcgtcgtatgcacagtcagcaggcgcgcattattgccttcccgctggcgttggtggtgctgtacatcatcattaaactcgccaccacaaaagtaccgttactggggtaagtcatgagatcgttagctgatttcgaatttaataaagcgccattgtgcgaaggcatgatcctggcttgcgaagcaatccgccgcgattttccctcgcaagatgtttacgacgaactggagcgtctcgttagtctggcgaaggaagaaatcagccagcttctgcctttagaagagcagttggaaaaactgatcgcgctgttttacggcgactggggatttaaagcctcacgcggtgtttatcgtctttccgatgcattatggctggaccaggtgttaaagaatcgacagggcagtgcggtatcattaggtgcggttttattatgggtcgcgaatcgtctcgatttgccgctgctgccggtgattttccctacgcagctgatattgcgcattgaatgtccggatggcgaaatttggctgattaatccttttaacggtgaatcgttaagcgaacatatgctggacgtatggttaaagggaaatatcagcccgtcggcggaactgttttatgaagaccttgatgaagctgataacattgaggtaatccgcaaattgctggatacactcaaagcctcgttgatggaagaaaatcagatggagctggcgttacgcaccagcgaagctttattacaattcaaccctgaagatccctatgaaattcgcgatcgcgggttgatttatgcgcaactggattgcgaacacgttgcgttgaacgatttaagttatttcgttgaacagtgtccggaagacccgatcagcgaaatgatccgtgcgcaaataaataacatcgcgcataaacatattgtgctgcattaattaatcgacattttactcaagattaaggcgatcctatgaaacaaaaagtggttagcattggcgacatcaacgtagcaaatgacctgccgttcgtactgtttggcggtatgaacgtgttggaatctcgcgatctggcgatgcgcatttgcgagcactacgtaactgtgacccagaaactgggtatcccttacgtgttcaaagcctcttttgacaaagccaaccgctcctccatccactcttatcgtggaccgggcctggaagaagggatgaaaatcttccaggagttgaagcagacttttggcgtgaaaattatcaccgacgttcacgaaccaagtcaggcacagcccgttgctgatgtcgtggatgtgattcagttgccggcgtttcttgctcgccagactgacctggttgaagccatggcgaaaaccggtgcggtaattaacgtcaagaaaccacagtttgtcagcccgggacagatgggtaatatcgttgataaattcaaagaaggcggcaacgaaaaagtgattctttgcgatcgcggtgctaacttcggctatgacaacctggttgtcgatatgctgggcttcagcattatgaagaaagtgtctggtaactcgccggtgattttcgacgtgacccacgcactgcaatgccgcgatccgtttggcgcagcttccggtggtcgtcgtgctcaggtggctgagctggcacgagccggtatggcggtaggtctggcggggctgtttattgaagcgcatccggatccggaacatgcgaaatgtgatggtccatccgcgctgccgctggctaaactggaaccgttcctcaagcagatgaaagcgattgatgatctggtgaaaggtttcgaagaactggataccagcaagtaatctttttgtttgaaaaataaagtcttagcgttgtgcgttaagacttttttatgggtgccggatacaaaaaaggccgcaggctgttacccctgcggccggtttcgggcgcatattgccatcacggcagcctgacgcccgttttcaccttacttccggttacgccaccagccgacaatcgctgcggtaataattcccgccaggatcggtgctgccaggtcgtcccagaaaatcatggcaaactgcgcgagcgtcatatagccgccttgttgtaatgacaacattttgcggctattcttgaattgttctggttcaagattagcccccgttctgttgtcaggttgtacctctcaacgtgcgggggttttctctttccagcaaccaatgccaccagggataaagcccccgcaacattgcgcctcaccggataacgccggcttggtgtggatactacgactcaattcatcttcacttcatccctgaaatgtttgcaatgaagagtgcattccggtttttcaacagctgttacagtcatttcatgagtgctctggatgaggcttccagctcgggttgccaatatttacttgtggaagtgataaagacaaaaatggccgcaggctgttacccctgcggccggtttcgggcgcatattgccatcacggcagcctgacgcccgttttcaccttacttccggttacgccaccagccgacaatcgctgcggtaataattcccgccaggatcggtgccgccaggtcgtgccagaaagtcatggcaaactgcgcgagcgtcatatagccgccttgttgtaatgacaacattttgcggctattcttgaagtgtctggtttcaagattagcccccgttctgttgtcaggttttacctctcaacgtgcgggggttttctctttccagcaaccaatgccaccagggataaagcccccgcaacattgcgcctcaccggataattccggcttggtgtggatactacttctcaattcatcttcacttcatccctgaaatgtttgcaataaagagtacattccggcttttcaacagctgttgcagtcgtttcatgagtgctctggatgatgcttccagctcgggttgccaatatttacttgtggaagagataaagacaaaaatggccgcaggctgttacccctgcggccggtttcgggcgcatattgccatcacggcagcctgacgcccgttttcaccttacttccggttacgccaccagctgacaatcgctgcggtaataatccccgccaggatcggtgctgccaggtcgtgccagaaagtcatggcaaactgcgcgagcgtcatatagccgccttgttgtaatgacaacattttgcggctattcttgaagtgtctggtttcaagattagcccccgttttgttgtcaggttttacctctcaacgtgcgggggttttctctttccagcaaccaatgccaccagggataaagcccccgcaacattgcgcctcaccggataattccggcttggtgtggatactacttctcaattcatcttcacttcatccctgaaatgtttgcaataaagagtacattccggcttttcaacagctgttgcagtggtttcgtgcaggttgtggtacaggctcgcaattctgattaacgagctgtccaggtagtatgaagaaatacaataagcaggaatttatcttatctcccccgatttccgtcatcggaggagatataactgtcaggcaaatatcgtcatcaaataggcggcaaacagtgccagatgcgctgcgccattgagcacgttagtacgtccggtggagaaggagatatggcacagcactaaagaggccaccatcaccaccatttctggcgcaccaagtgcaaactgtaattcgttacccgtcataaaggcaattagcgtgacgacaggtacggtaagcgaaatggttgctaacactgaaccaaagaacagattcatcgcgcgctggacctggttgttcaacactgcttttaacgcacctaaaccttccggcgacagaatcaacagagccaccaggaagccagtaaaggcgacaggggcattcatgctgtcgagcaatgtctccagcgggctggcattcattttggtgactgcaataacggcaatcagatggataatcaaccagatagcatgccacacgctgctatgggcagacggtttaccgtgatgcgggtcgtcgtcatcactgtcatcttcgtgctcgtagacaaacaaactttgatgcgttttggtctggatcagcaaaaatacgccatacattgccgcagaaattaatgctaccagtaacgcctgaccggttgaaaaattcgccgcaggcagagccattggaaataccagtacgattatcgccagggggaacagcgcaattaaatactgcttgataccaaacagattcatatattgggtggcaaacttacgaccgcccaacaataatgaaaagccaaccagcccaccggtaacaatcataatgattgaatagagcgtatcacgcattagcgttggcgcggcgtcgccggttgccattaaagctgaaatcaaactgacttcaagaataaccactgaaaggctaagaataagcgaaccgtaaggttctcccaggcgatgggctaatacgtccgcatgacggacaacactaaaggcgctacttaaaataccaataagcgcaagaagattgatggcaatgaccactggtagtgtctggctgcttccccacaggaacagcactaccagcgccagaaccgggaaaataagcgaagtctccttgtggcgggtttttaccgcctcttgagcatttgacattatggttatccctttgcagatgaatttatcgaaaatgtaaaaaataggtaggaaaaataacagaaagtgtctggatatcggtaacattttacgaatttttaccccactgtcgattttttactcattgggacataaaaataagtattacgtttagacaatgtttgttttagcgtttcttaagaacagtctgacatgaaaattcttatgttttggcaagagtagatattgttgaccacacttaatgttcaactttgtaaaaggagtcaacgatgccgtataaaacgaaaagcgatctgccggaaagcgtaaagcacgttctaccgtctcatgcccaggatatctataaagaagcgttcaacagcgcgtgggatcaatataaagataaagaggatcggcgtgatgacgccagtcgcgaagaaaccgcgcataaagtggcctgggctgctgtgaagcatgaatatgccaaaggggatgatgataaatggcataaaaaatcgtaaaaccggtagcttagttaaagctattcgtgcggtgttgccttgcaagtggtccgtggattgcatattgtcccgttagtggtttcaaaatgagcagtaaaaatgtccggaagacaccaaaaagttgtcgcagggaagtatgcagtggcggaggtgtaaggtgataacgcgtgatttcttgatgaatgccgattgtaaaacggcatttggtgccattgaagaatcactcttatggtcagcagagcaacgggcggcttcgctggcggcgacgctggcttgtcgacctgatgagggaccggtgtggatcttcggttatggatcgttgatgtggaatccggcactggagtttaccgagtcgtgcaccggtacactggttggatggcatcgcgcgttttgcctgcgcctgaccgccgggcgcgggactgcgcaccagccgggacggatgcttgcactgaaagagggcggacgcactacaggcgtcgcctatcgactgccagaagagacgctggagcaggaactaaccctgttgtggaagcgcgagatgattaccggctgttatctgccaacctggtgtcagcttgatcttgatgatggatgcacagtaaacgccattgtgtttattatggacccgcgacatccagaatatgaatctgacactcgcgctcaggtcatcgcgccgttgattgcggcggcgagcggtccgctgggaaccaacgcacaatacctgttttcactggaacaggagcttatcaaactgggaatgcaggacgatgggctgaatgatttgctggtatcggtaaaaaaactgctggcggagaattatccggatggtgtgttacggccgggattcgcctgagtaaacttccctcatagtggggcgtcagacgccccctcaaacattaaaatgtgagcactttatcggctgacagcgtccattgcgccagttccacaagagtaccgatttccaccccatcaataagaggaagtgtgctaatcccgcgcccgtcggtacaggttttgcacaatttcaccggtacattctgagcggtaaggatctccagcatttgctgaatgttgtagccttcccctggtttttgcccgcgcaacccggctgtgaccgcatcagacatgaggaacagacgcagatccagattgctctcctgctctcgtaacgcaatggccagccgcaagctgttaaacaaggattcgctcccgtaaggtgcgccattggcaacgatcacgattttttgcattatttactcctgtattcagggaattagacactcatcttctatcttactgcttctgcagcgtctgaccaatcggtcacatttttaaggattttcctgaaagcgcgagaaaatacgacaaaagttgccagtaatcgttattcttaaaggctatggtttttcattttttaccggaagttaccgacgttttgagccgtttcgttcctcgcattatttcgttttatttactcttgctggcggcaggcggtacagctaacgcacaatctaccttcgagcaaaaagcggcaaatccctttgataataacaatgatggtctgccggatttaggcatggcacctgaaaatcatgatggggaaaaacactttgctgaaattgtgaaagatttcggcgaaaccagtatgaatgataacgggctggatactggcgagcaggcaaaagctttcgcattgggaaaagtccgcgacgcgcttagtcaacaggttaatcagcacgtagagtcctggctatcaccgtggggaaatgccagtgttgatgtcaaagtggataacgaaggtcattttaccggcagtcgtggaagctggtttgtgccgttacaagataatgatcgttatctcacctggagccagcttggtcttactcagcaggatgatgggttggtgagcaatgtgggcgttgggcaacgctgggcgcgcggcaactggctggtgggttataacactttttatgacaacttgctggacgaaaatcttcagcgagcgggctttggtgccgaagcgtggggcgaatatttgcgactatcggcaaacttttatcagccatttgctgcatggcatgaacagacagccacgcaggaacaacggatggcgcgcgggtacgacctgacagcccggatgcgcatgccgttctatcaacacctcaataccagtgtcagcgtagaacagtattttggtgatcgtgttgatttgtttaactctggtacgggttatcacaatcccgtcgcgttgagtctgggattaaattacacccctgtgccattagtcactgtgacggcccagcataaacagggtgaaagtggcgagaatcaaaataacctcgggctgaatcttaattaccgctttggtgtaccgctcaaaaaacaactttctgcgggcgaggttgccgaaagtcagtcgttacgtggtagtcgctatgataatccgcagcgaaataatctaccgactcttgagtaccgacagcgaaaaacgttaacggtgtttctggcgacaccgccgtgggatctaaaacctggcgaaacagtgccgctgaaattacaaatccgcagtcgttacggtattcggcaactgatttggcagggcgatacgcagatattaagtttgacgccaggcgcacaagccaacagcgcggagggctggacgctgatcatgcctgactggcagaacggggaaggggcgagcaatcactggcgattgtcggtggtggtggaagataaccaggggcagcgtgtctcctccaatgagatcacgctaacgcttgtcgaaccgttcgacgcattgtcaaacgacgaactgcgctgggaaccgtaatcagaaaatgcgctcctgatgcacccataccgctgcttccacgcgagacttgagcttcattttcttcagcatgtgcttgacgtgcacttttactgtgctttcggtgatatccaggcggcgggcaatcatcttgttcggcaaaccctgggcaatcagcttgagaatatcgcgctcgcgtggggttaactggttaacatcgcgctcagtagtggcacggttagcgcgcaagctggcggccagaacaggcgttaatgcttcgcttaataccatttcgccagcagctgcctgatgcaatgctttcagcagatcttccggttccatatcttttaacagatagccatccgcgccgcgtttcagtgcggtgaccacatcttcttcatggttagagacgctgaataccacaatgcgccctgagagggacttttcgcgcagtttatccagcgtttccagaccgttcatgccgggcatattgagatctaacaggatcagatcgggatcaagagactccgccagttcaataccctgttcgccattactcgcttcgccaaccacggtgatatctggtgccatactgataagctgttttacgccagttcgcagcatcgggtgatcgtcaatcagcaggatagtagccggttcctgattactcatgggtatctccttggacgtctgtgaaagttttttcgggaataaaggtgaccaccacttcggtgccacctgattcacgacggcggacgcggcaatcgcctcgtaaactttgcgcacggtcgcgcattattatcatgccgtagtgattgctgcggatggcattttcaggcacgccgcagccgttatcctggacggtcagtttgacctgattatcgttttgcgccaccgtcaccacgacctcactcgcttgcgaatgtttgagggcgttacttaatgcctcacgggcaatttgcaacaagtggattgcctgatgtgaaggcaccagacgaggcggcaattgataatccagcttcaccgggaagccaaatttggcgctgtactcttcgcaactcgcttccagcgccggacgtaatccaggctcggtgagctgcaagcggaatgtggtgagcaattcacgcaactgcgcccaggatgcattcagttcgttacggatctgacttaacagttcgcggctgctttctggcagcgcatcgccctgcatctgtaaacaactcacctgcatcttcatgcaagagagagattgggcaatagaatcatgcagttcgcgcgcaatggtggcacgctcttccatcacgatcaactgttgctgacgttcctgatgccgatccagcgccagcgtggcggtgagttgttcaaccagggtatccaccagttgttgttgatcatggctaagatgacgcccctgcggtagggtcgccagcaaaataccgtactgcgtatgtgagtcagccagccgccacttcagggttgtgccgcgatcgccaacgggtaatacgccgcgcgggcagagctggcagcctttatcatcacaagtcatatctggctggcaggtaaactcctgatgattctcttcatcatcagtgtcatacacccgcaattcgatatcacgtagcagggttaaattctgtaagccgttgagtacaggtgacaggcgttcacacagcggggcgcgggaatgcaaacggcggttagcctgccataaaaaagagaggatctgatttttatgctccagcccggcggttttctcctgaacccgctgctcaagtacggcataactttcggccagttctgcagacatattgttcaatgcagttccaagcatcgccatttcgttgcgcccgctgatgttcgcgcgttgggtaaaatcgcgatgactgacggcactcgccattgccagcagttgccgccacggttgtagcagtcgcgcccgcaaccagataatagtgaacaccagtaaaagtgccataaataccgccattacccgatggaccagtaccactgtctcaatgcgcatttccgtggtgcggtcaaaaccagataccagctgatcaagcccggcaacaaactggctgacatccgctgacaccgtttcgcggttttgtgcacgcatcagtgcagggatcagttcattacgccagtaatcttgtaaaccctgtaattgcgccagttgtccgtctcgttctgctgctcgagtcaactcggcgctaaatgccgtttgttccatctctttaattaagggcttgtctttctcgcttaatggcaatgctgccaacagacggtaactttgcatgcgcagcgatcccgctttgttgatcgcatgggcgctgccctgaacgccttgcaccagccagccagaaaccgccatccctgccagtccaatagcagtagaaagcaacacaataagcgcaacctgattaaccagggtgagcggagagagacaacgtttaagcatgtaaacctcttccttcaggctttaaatgagcaataaccttaatgaatgtgacgatacattctggaatggcagtattctcggctattggctgaagtatacccatacccggaaagagttactccttatttgccgtgtggttagtcgctttacatcggtaagggtaggaattttacagcaccgtgaaaaatctcataatttttatgaaatcactgtactcactatgggtaatgataaatatcaatgatagataaagttatcttatcgtttgatttacatcaaattgcctttagctccagacactaaggtggcagacatcgaaacgagtatcagaggtgtctatgagtcactcatccgcccccgaaagggctactggagctgtcattacagattggcgaccggaagatcctgcgttctggcaacaacgcggtcaacgtattgccagccgcaacctgtggatttccgttccctgtctgctgctggcgttttgcgtatggatgttgttcagcgctgttgcggtgaacttaccgaaagtcggttttaattttacgaccgatcagctatttatgttgactgcgctgccttcggtttctggcgcgttattacgtgttccatactcctttatggttcctatcttcggtggtcgtcgctggacggcgttcagcaccggtattctgattattccttgcgtctggctgggttttgccgtgcaggatacctccacgccttatagcgtcttcatcatcatctctctgctatgcggctttgctggcgcgaacttcgcatccagtatggcaaacatcagcttcttctttccgaaacagaagcagggtggcgcgctgggtctgaatggtggtctgggaaacatgggcgtcagcgtcatgcagttggttgctccgctggtggtatcactgtcgattttcgcagtatttggtagccagggcgtcaaacagccggatgggactgagctgtatctggcgaatgcgtcctggatatgggtgccgttccttgccatcttcaccattgcggcgtggtttggcatgaacgatcttgctacctcgaaagcctccatcaaggagcagttgccggtactcaaacggggtcatctgtggattatgagcctgctgtatctggcaaccttcggctccttcatcggcttctccgcgggctttgcaatgctgtcaaaaacgcagttcccggatgttcagattctgcaatacgctttcttcgggccgtttattggtgcgctggcgcgttctgcaggtggtgcattatctgaccgtctgggcggaactcgtgtcacgctggtgaactttattctgatggcgattttcagcggcctgctgttcctgaccttaccgactgacgggcagggcggaagcttcatggcgttcttcgcggtcttcctggcgctgttcctgacagctgggctgggtagtggttccactttccagatgatttcagtgatcttccgtaaactgacaatggatcgcgtgaaagcagaagggggttctgacgaacgtgcgatgcgtgaagcggcaaccgacacggcggcggcgctgggtttcatctctgcgattggcgcgattggtggcttctttatcccgaaagcgtttggtagctcgctggcattaacgggttcgccagtcggcgcaatgaaggtatttttgattttctatatcgcctgcgtagtgattacctgggcggtatatggtcggcattctaaaaaataaaccgttactcgtcatacttcgggttacatgtgctgcggctgcgttcattcaccccagtcacttactttagtaagctcctgggattcattcacttgccgccttcctgtaaaccgaattatatagagtaaaatatttgattatcctttgcgcggcatgatgtcgcgctttttttatgcgttatttagttacaacatactaatgttatatgatttatttcgccggatttcattaagagccattaatatgttacccatggggaatactccttaatacccatctgcataaaaatcttaatagtttaaataactacaggtataaaacgtcttaatttacagtatgttatgtggtggctgttaattatcctaaaggggtatcttaggaatttactttatttttcatccccatcactcttgatcgttatcaattcccacgctgtttcagagcgttaccttgcccttaaacattagcaatgtcgatttatcagagggccgacaggctcccacaggagaaaaccgatgagtaaattcctggaccggtttcgctacttcaaacagaagggtgaaacctttgccgatgggcatggccagcttctcaataccaaccgtgactgggaggatggatatcgccagcgttggcagcatgacaaaatcgtccgctctacccacggggtaaactgcaccggctcctgcagctggaaaatctacgtcaaaaacggtctggtcacctgggaaacccagcagactgactatccgcgtacccgtccggatctgccaaaccatgaacctcgcggctgcccgcgcggtgccagctactcctggtatctttacagtgccaaccgcctgaaatacccgatgatgcgcaaacgcctgatgaaaatgtggcgtgaagcgaaggcgctgcatagcgatccggttgaggcatgggcttctatcattgaagacgccgataaagcgaaaagctttaagcaggcgcgtggacgcggtggatttgttcgttcttcctggcaggaggtgaacgaactgatcgccgcatctaacgtttacaccatcaaaaactacggcccggaccgtgttgctggtttctcgccaattccggcaatgtcgatggtttcttacgcatcgggtgcacgctatctctcgctgattggcggtacttgcttaagcttctacgactggtactgcgacctgcctcctgcgtctccgcaaacctggggcgagcaaactgacgtaccggaatctgctgactggtataactccagctacatcatcgcctggggttcaaacgtgccgcagacgcgtaccccggatgctcacttctttactgaagtgcgttacaaaggcaccaaaactgttgccgtcacaccagactacgctgaaatcgccaaactgtgcgatctgtggctggcaccgaaacagggcaccgatgcggcaatggcgctggcgatgggccacgtaatgctgcgtgaattccacctcgacaacccaagccagtatttcaccgactatgtgcgtcgctacaccgacatgccgatgctggtgatgctggaagaacgcgacggttactacgctgcaggtcgtatgttgcgcgctgctgatctggttgatgcgctgggccaggaaaacaatccggaatggaaaactgtcgcctttaataccaatggcgaaatggttgcgccgaacggttctattggcttccgctggggcgagaagggcaaatggaatcttgagcagcgcgacggcaaaactggcgaagaaaccgagctgcaactgagcctgctgggtagccaggatgagatcgctgaggtaggcttcccgtactttggtggcgacggcacggaacacttcaacaaagtggaactggaaaacgtgctgctgcacaaactgccggtgaaacgcctgcaactggctgatggcagcaccgccctggtgaccaccgtttatgatctgacgctggcaaactacggtctggaacgtggcctgaacgacgttaactgtgcaaccagctatgacgatgtgaaagcttataccccggcctgggccgagcagattaccggcgtttctcgcagccagattattcgcatcgcccgtgaatttgccgataacgctgataaaacgcacggtcgttcgatgattatcgtcggtgcggggctgaaccactggtatcacctcgatatgaactatcgtggtctgatcaacatgctgattttctgcggctgtgtcggtcagagcgggggcggctgggcgcactatgtaggtcaggaaaaactgcgtccgcaaaccggctggcagccgctggcgtttgcccttgactggcagcgtccggcgcgtcacatgaacagcacttcttatttctataaccactccagccagtggcgttatgaaaccgtcacggcggaagagttgctgtcaccgatggcggacaaatcccgctataccggacacttgatcgactttaacgtccgtgcggaacgcatgggctggctgccgtctgcaccgcagttaggcactaacccgctgactatcgctggcgaagcggaaaaagccgggatgaatccggtggactatacggtgaaatccctgaaagagggttccatccgttttgcggcagaacaaccagaaaacggtaaaaaccacccgcgcaacctgttcatctggcgttctaacctgctcggttcttccggtaaaggtcatgagtttatgctcaagtacctgctggggacggagcacggtatccagggtaaagatctggggcaacagggcggcgtgaagccggaagaagtggactggcaggacaatggtctggaaggcaagctggatctggtggttacgctggacttccgtctgtcgagcacctgtctctattccgacatcattttgccgacggcgacctggtacgaaaaagacgacatgaatacttcggatatgcatccgtttattcacccgctgtctgcggcggtcgatccggcctgggaagcgaaaagcgactgggaaatctacaaagccatcgcgaagaaattctccgaagtgtgcgtcggccatctgggtaaagaaaccgacatcgtcacgctgcctatccagcatgactctgccgctgaactggcgcagccgctggatgtgaaagactggaaaaaaggcgaatgcgacctgatcccaggcaaaactgcaccgcacattatggtcgtagagcgcgattatccggcaacttacgaacgctttacttctatcggcccgctgatggagaaaatcggtaacggcggtaaagggattgcctggaacacccagagcgagatggatctgctgcgtaagctcaactacaccaaagcggaaggtccggcgaaaggccagccgatgctgaacaccgcaattgatgcggcagagatgatcctgacactggcaccggaaaccaacggtcaggtagccgtgaaagcctgggctgccctgagcgaatttaccggtcgtgaccatacgcatctggcgctgaataaagaagacgagaagatccgcttccgcgatattcaggcacagccgcgcaaaattatctccagcccgacctggtctggtctggaagatgaacacgtttcttacaacgccggttacaccaacgttcacgagctgatcccatggcgtacgctctctggtcgtcagcaactgtatcaggatcaccagtggatgcgtgatttcggtgaaagcctgctggtttatcgtccgccgatcgacacccgttcggtgaaagaagtgataggccagaaatccaacggcaacccggaaaaagcgctcaacttcctgacgccgcaccagaagtggggtatccactccacctacagcgacaacctgctgatgctgactttaggtcgcggtggtccggtggtctggttgagtgaagccgatgccaaagatctgggtatcgccgataacgactggattgaagtattcaacagcaacggtgctctgactgcccgtgcggttgtcagccagcgtgttccggcagggatgaccatgatgtaccacgcgcaggaacgtatcgttaacctgcctggttcggaaattacccaacagcgtggtggtatccataactcggtcacccgtatcacgccgaaaccgacgcatatgatcggcggctatgcccatctggcatacggctttaactactacggcaccgtaggttctaaccgcgatgagtttgttgtagtgcgtaagatgaagaacattgactggttagatggcgaaggcaatgaccaggtacaggagagcgtaaaatgaaaattcgttcacaagtcggcatggtgctgaatctcgataagtgcatcggctgccacacctgttcagttacctgtaaaaacgtctggaccagccgtgaaggcgtggaatacgcgtggttcaacaacgtggaaaccaagccgggtcagggcttcccgactgactgggaaaaccaggaaaaatacaaaggcggctggatccgtaaaatcaatggcaaactgcagccgcgcatgggtaaccgcgccatgctgctgggtaaaatcttcgctaacccgcatctgccggggatcgacgattattacgagccgttcgattttgattatcagaacctgcataccgcgccggaaggcagcaaatcgcagccgattgcccgtccgcgttcgctgattaccggggaacggatggcgaaaatcgaaaaagggccgaactgggaagatgacctgggtggtgagtttgacaaactggcgaaagacaagaacttcgacaacatccagaaggcgatgtatagccagttcgaaaacacctttatgatgtatttgccgcgcctgtgcgaacactgcctgaacccggcatgtgtggcgacctgcccgagcggtgcgatttacaagcgtgaagaagatggcatcgtcctgatcgaccaggataaatgccgtggctggcgtatgtgcatcaccggatgcccgtacaaaaaaatctacttcaactggaagagcggtaagtctgagaagtgcatcttctgctatccgcgtattgaagcgggtcagccgaccgtgtgctcagaaacctgtgtcggtcgtatccgttatcttggcgtgctgctgtacgatgccgacgcgattgaacgtgcagccagcaccgagaacgagaaagatctttaccagcgtcagctggaggtgttcctcgatccgaacgatccgaaagtcatcgagcaggcgattaaagacggtattccgctgagcgttattgaagccgcacagcagtcgccggtttataaaatggcaatggaatggaaactggcgctgccgctgcatccagaatatcgcacactgccgatggtctggtacgtgccgcctctgtctccgattcagtctgcagcagacgcgggtgagctgggtagcaacggcattctgccagacgtcgaaagcttgcgtattccggtacagtatctggcgaatctgctgaccgccggtgataccaaaccggtactgcgcgcactgaaacgtatgctggcgatgcgtcattacaaacgtgttgaaaccgttgacggtaaagttgatacccgtgcgctggaagaggtcggtctgaccgaagcccaggcacaggagatgtaccgttatctggcgattgctaactacgaagatcgctttgtggtgccgagtagtcatcgtgaactggcacgggaagccttcccggagaaaaatggctgcggctttacctttggtgatggctgccacggttcagataccaaattcaatctgttcaacagccgtcgtatcgatgccatcgatgtgaccagcaaaacggagccgcatccatgatcgaactcgtgattgtatcgcgtctccttgaatatccggatgctgccttatggcagcatcaacaagagatgtttgaggcgattgctgcgtcgaaaaatctgtcgaaagaagatgcccatgcgctgggcattttcctgcgcgatttaacggcgatggatccgctcgatgcccaggcccagtacagcgaactgttcgaccgtggccgcgccacgtcactgttgctatttgaacatgttcacggtgaatcccgtgaccgcggccaggcgatggtggacctgctggcgcagtacgagcagcacggtttgcagttaaacagccgcgaattaccggaccatctgccgctgtatctggagtacctgtcgcagctgccgcaaagcgaagccgtggaaggtttgaaagatatcgcgccgattctggcattgctgagcgcgcgtctgcaacagcgtgaaagccgttatgccgtgatgtttgatctgctgctgaaattggccaataccgctatcgacagcgacaaagtggcggaaaaaattgccgacgaagcgcgcgatgatacgccgcaggcgctggatgctgtctgggaagaagagcaggttaaattctttgctgacaaaggctgcggtgattcagcaatcactgctcatcagcgtcgctttgccggtgccgtcgcgccgcaatatctgaatatcaccaccggaggacagcactaatgcaattcctgaatatgttcttctttgatatctacccgtacatagccggggcggtcttcctgattggtagctggctgcgttatgactacgggcagtacacctggcgcgcggcgtccagccagatgctggatcgcaaagggatgaacctggcgtcgaacctgttccatatcggtattctggggatttttgttggtcacttcttcggtatgctgacgccgcactggatgtatgaagcctggctgccgattgaagtgaaacagaaaatggcgatgtttgctggtggtgccagcggcgtgctgtgtctgattggcggcgtgctgttgctgaagcgtcgtctgttcagcccacgcgtgcgtgcaaccactaccggagcggatatcctgatcctgtcgctgctcgttatccagtgcgcgctgggcctgttgaccattccgttctccgctcagcatatggacggtagcgagatgatgaaactggttggctgggcgcagtcggtggtgaccttccacggtggcgcttctcaacacctcgatggtgtggcgtttatcttccgtctgcacctggtgttggggatgacgttattcctgctgttcccgttctcgcgtctggtgcacatctggagcgtaccggtggagtatctgacacgtaagtatcagttggtgcgcgctcgtcactaagcgaattttagttcacatagaccctgcttcggcagggtttttttatgggcacggtgcggggtgagttgtcggatgcgcttcgcttatccgacctacaggggaggatattgtaggtccggtaaacgcggtgccatcgggcaaaattagctcggagtaacaggttttgagtatttcaggaagtgatggtggtgggggaaggattactcagcgctgcgcgcttcgcccttcgggtcgttgcctgcggcaacgctctctcgctggcgctcaagtcgaaccttggtcgaagcttctcatccttccccgcttgggcagaatatttaattacggattcgtttgagagttcagggacttttgaaagtgatggtggtgggggaaggattcgaaccttcgaagtcgatgacggcagatttacagtctgctccctttggccgctcgggaaccccaccaggggtaattcaaatttcgaggtaatgcttgagatggtggtgggggaaggattattcgtcgcttcgctcctcacccttcgggccgttgcctgtggcaacgttctctcgctttcgctcgaatcgaaccttagtcgaaggttctcacccttccccgatgagtgcaaactttcacaatctcaccgaagttaccacatcactgtggtgaattatggtggtgggggaaggattattcgtcgcttcgctcctcacccttcgggccgttgcctgtggcaacgttctctcgctttcgctcgaatcgaaccttagtcgaaggttctcacccttccccgatgagtgcaaactttcacaatctcaccgaagttaccacatcactgtggtgaattatggtggtgggggaaggattcgaaccttcgaagtcgatgacggcagatttacagtctgctccctttggccgctcgggaaccccaccacggggtaatgctttttactggcctgctcccttatcgggaagcggggcgcatcatatcaaatgacgcgccgctgtaaagtgttacgttgagaaaaatgaactggttgcgtaattttcatccgtaacggattaaaggtaaccagttatttttgctggcgattaaagaataatcgtccgattaccgtaaacaaagacgcgctgtgccagtactttgtatagtgcacgacttaagacgtttttctcgacgtcacgacctgcgcgcatcatatcttcagctgtgtaggtatgatcgacatgaataacgtcctgcatgatgattgggccttcgtccagattgtcattcacatagtgagcggttgcgccaataatcttcacaccacgttcataggcctggtgataaggacgtgcgccaataaacgctggcaggaatgaatggtgaatattgatgatcttattcgggaagcgtgccacaaattccggcgttaatacccgcatatacttcgccagcaccacgtagtcaggttgataagcatcaatggcatccgccatcttttgatcgtgctcgttgcggcttaacccttcatggcttaccagctcaaacggaatatcaaaacgctcaaccagagaacgtagagtatcgtggttaccaataactgccgcgatttcgacatccaggccgccgtaattggctttcatcaacaaatcgccaaggcaatgcgcttctttagtgaccagaatcactatccggcgacgaccggcaggattcagctcacgcacggagccttctggcaatgcgctatcgagatccgccagcagggtggaatcattaaaaatcccttccagttccgtgcgcataaaaaagcgcccggtacggtgatcaacaaattcattgttctgtacgatatttaactcgtgcttgtagcaaatattggtaatacgtgcgatcagacctttttggtccggacaaatagtacgcagaactttacgttggagtgaatgcattgctggaaaaaccttgttgagagtgtttgctaaaccgtaccgtcaaccattattggccgcagcactttttaaattttttacctgaaccacaagggcagggatcgttgcggccaaactgcggacgtgtaccgtcaatatagtaccattgaccgttttctttcaaaaatcgcgaacgttcaattattgcacctgttttgccaccttcggtaaatcgagcaacaaaactgacaaatccgatattgtcggcgtcctgccaacaatgttcaaatacggtcaatcccaaccattcagtatgcgcaaatccggcaatcaattcggcacgtaacgccgctgctccacaagatggatgccaggtctttattaaataatctgcgtcttgcatcacaaaagcgcagtaacgcgaacgcatgagatgttctggatcaggtgcaaccttttcaccagacacataagggtggcaacataggctatactcgacagcactaccacagggacaaagctgagacacaaataatctccctggaaacaataacggcgtattaaccgcctgagtagcactatgttaaccgagcagtagcgatgtggctacgattgcattccaggggaatcttgcgggaataatgagaaagataaaaatagggctggcgctgggatctggcgcggcgagaggttggtcgcatattggcgttattaatgcgctaaaaaaagtgggtattgaaattgatatcgttgcaggatgttcaattggttcgctggtgggcgctgcctatgcatgcgatcgattatctgcgctggaagattgggtgacctctttcagttattgggatgttttacgcctgatggatctctcctggcagcgcggtgggttactgcgcggcgagcgtgtcttcaatcaataccgcgaaataatgccggaaacagagatcgaaaattgttcccgtcgctttgcggctgttgccaccaatttaagtacgggacgtgaattatggtttactgaaggcgatctccatcttgctattcgcgcatcatgcagtattccaggactcatggcacctgttgcacataacggctactggctggttgatggagcagtcgttaacccaattcctatttccctcacgcgtgcattgggggctgatattgtgatagcggttgacctgcagcacgatgctcatttgatgcaacaagatttgctctcctttaatgtcagtgaagaaaatagcgagaatggtgattctctgccgtggcatgcgcgtctgaaagaaaggttaggcagcataacgacacgtcgggcggtgacagcgccaacggcaacagagattatgaccacttctatccaggtgctggagaaccgccttaaaaggaaccgcatggcaggtgatccgcccgatattctgattcaacctgtttgcccgcaaatatctacgcttgatttccatcgcgcgcacgctgccattgcggccggacagctggcagtggaaaggaaaatggacgaacttttgccgttggtacgcaccaacatttgaccagaatttttatctacacttaagttaattctgacaggcgcaggtggcaatagcatgccactattgagtaaagccagtcaggggagagaacatgacgcagccattggtcggaaaacagattctcattgttgaagatgagcaggtatttcgctcgcttctggattcatggttttcctcattgggagcgacaacggtactggcggctgatggggtggatgcccttgagttgctgggaggtttcactccagacctgatgatatgtgatatcgcgatgccacgaatgaacgggcttaaactgctggagcatatacgtaacagaggcgaccagaccccagttctggtgatatctgccactgaaaatatggcagatattgccaaagcgttacgtctgggcgttgaagatgttttgctgaaaccagttaaagatctgaatcgcttgcgcgagatggtttttgcctgtctctatcccagcatgtttaattcgcgcgttgaggaagaggaaaggctttttcgcgactgggatgcaatggttgataaccctgccgcagcggcgaaattattacaggaactacaaccgccggttcagcaggtgatttcccattgccgggttaattatcgtcaattggttgccgcggacaaacccggcctggtgcttgatattgccgcactttcggaaaacgatctggcattttattgccttgatgtcacccgagctggacataatggcgtacttgctgccttgttattacgcgcattgtttaacggattattacaggaacagcttgcacaccaaaatcaacggttgccagagttgggcgcgttattgaagcaggtaaaccatttacttcgtcaggccaatctgccggggcagtttccgctattagttggctattatcatcgcgaactgaaaaatctcattctggtttctgcgggtctgaatgcgacgttaaataccggcgaacaccaggtgcaaatcagtaatggtgttccgttaggcactttaggtaacgcttatttgaatcaattgagccagcgatgcgatgcctggcaatgccaaatatggggaaccggtggtcgactgcgcttgatgttgtctgcagaatgagcaaacgataacgcgggctaaatttgcattacctgctaatgtcggctggtggtactatcgtcgccattcgtataagtaattgtcttaattatgctaactcgcctccttttcagaacttagccccttcggggtgctgatatactgggatgcgatacagaaatatgaacacgttcaaaacacgaacagtccaggagaatttaaatggctgccattaatacgaaagtcaaaaaagccgttatccccgttgcgggattaggaaccaggatgttgccggcgacgaaagccatcccgaaagagatgctgccacttgtcgataagccattaattcaatacgtcgtgaatgaatgtattgcggctggcattactgaaattgtgctggttacacactcatctaaaaactctattgaaaaccactttgataccagttttgaactggaagcaatgctggaaaaacgtgtaaaacgtcaactgcttgatgaagtgcagtctatttgtccaccgcacgtgactattatgcaagttcgtcagggtctggcgaaaggcctgggacacgcggtattgtgtgctcacccggtagtgggtgatgaaccggtagctgttattttgcctgatgttattctggatgaatatgaatccgatttgtcacaggataacctggcagagatgatccgccgctttgatgaaacgggtcatagccagatcatggttgaaccggttgctgatgtgaccgcatatggcgttgtggattgcaaaggcgttgaattagcgccgggtgaaagcgtaccgatggttggtgtggtagaaaaaccgaaagcggatgttgcgccgtctaatctcgctattgtgggtcgttacgtacttagcgcggatatttggccgttgctggcaaaaacccctccgggagctggtgatgaaattcagctcaccgacgcaattgatatgctgatcgaaaaagaaacggtggaagcctatcatatgaaagggaagagccatgactgcggtaataaattaggttacatgcaggccttcgttgaatacggtattcgtcataacacccttggcacggaatttaaagcctggcttgaagaagagatgggcattaagaagtaacatccgtatcggtgttatccacgaaacggcgttgagcaatcgacgccgtttttttatagcttattcttattaaattgtcttaaaccggacaataaaaaatcccgccgctggcgggattttaagcaagtgcaatctacaaaagattattgcttgatcaggaaatcgtcgagggatttaccttgctcatccattgcttttttgattacagctggagtacggccttggccagtccaggttttagtttcgccgttttcgtcaacgtagctatattttgccggacgctgagcacgtttagctttggtgccagatttaacggcagcaaggctattcagcagttcgttcgggtcaataccgtcagcgatcagcatttcgcgatattgctgcagtttacgagtgcgctcttcaacttcagcagcagccgcgctttcttcttcgcgacgttcgttaacaacaacttctaatttttccagcatttcttccagcgtttcaagtgtacattctcttgcctgcgcacgaagagtacggatgttgttcagaattttaagtgcttcgctcattgtagtaatctcaaacttatattggggtggtttgttgaggtaataatagagccttaaattcagttgtgcaatagccaggaatgtaaggaattcaaaattgttctttattttgtgccgccaataaatatcttttcataaaattagccagaaaagacgcggcatatagccctatttgtaccgatgatttcgcagctcgtgaggttaaaacttcctgattcatgtcacattttatggggagattatcgtaggctgacgacctttcagtcttctgtattagtcgtgtttacgagaattccctattaagcgaatgatgaaaagtagaacagtcgcaataagagcagggacttagtattgcactatctcctggaggtcaacagagggctattacttgcgcaacagattaaagattgtgaatagttaccagcagtcatttacccgcttataacaagcgaggcagttgtaatgatagctcagaaggattatgcaaggcttcgtaagggagaacgcatataccacttctgtgcatactgttgagctgaaaaactgacgaattatgataaactccagccaactttatttcatatcattgagggcctgtggctgatggcacagctatatttctactattccgcaatgaatgcgggtaagtctacagcattgttgcaatcttcatacaattaccaggaacgcggcatgcgcactgtcgtatatacggcagaaattgatgatcgctttggtgccgggaaagtcagttcgcgtataggtttgtcatcgcctgcaaaattatttaaccaaaattcatcattatttgatgagattcgttcggaacatgaacagcaggcaattcattgcgtactggttgatgaatgccagtttttaaccagacaacaagtatatgaattatcggaggttgtcgatcaactcgatatacccgtactttgttatggtttacgtaccgattttcgaggtgaattatttattggcagccaatacttactggcatggtccgacaaactggttgaattaaaaaccatctgtttttgtggccgtaaagcaagcatggtgctgcgtcttgatcaagcaggcagaccttataacgaaggtgagcaggtggttattggtggtaatgaacgatacgtttctgtatgccgtaaacactataaagaggcgttacaagtcggctcattaacggctattcaggaaaggcatcgccacgattaataagaatttctttactgacagggtgagcagggcgcttttatcctgtcagttcgttttactcacttcttccgggctatacacccttctcggcagttttttaacgccgctatacgcctcacaggacgcttaagcaccgacgttgacttgtgacctgtaaagtacaatatccctgtgtttaggcgttatacatcgtcgcaaatatgatgaaggctaatgctgtcggtttatggaaaagttgctttgggtaaacaaaaaaacggccccagaagggcaatgccgttcacttaagaggagcggcactatgtttcacaggataacgggtttttgatatcttaaccgacctcggccttgatggtcgggggcgttttgttatgaacaccacttccagagcaccccgaagatgctccagtcgtttcgggatggtccctggtgacgccgtgtttcccagctctatcatttctgatgcgatattcttccacgcaggcagtagccagtggcggttacaacccttctggttcagcgtcagcagcaggtcttcgctgtaaaaaagtttatcaaacaacgtaatagagttatccgggatggtggcgagcatggagtgggccagcacagtttcgctctgccggtaaggtgcggtcacggcattcagcagaatgtgacttcccaggttcattaaggccaccagacgcataaccgggtaggcgttctgccgcttagtggatgtgttggcagacccataatattcacgcagctcgggtttatcaggtgtcctgaactgtgcgccatcaatggcaaaaagttgcaggccgtgccagtcatccttcaggtaacgttccgcgcccctgtctgtgcggtctggcggaagagccattccactggggcggcccccacgcgctgacgcgcctgggtgacagcgctgcgggccagcaggttcatccccgcttcgccatccgcgctcaggttcagacggcgaacaacatcggtaattggctcattgcaccaccatccagataaccatgtcccccggtaaacgacggcggcgaacggtcgcatgagcagaaagcgtcaggcagtgttgtatccactcggtgggaaggtgttctgcaaatagttgtgcagagggcggaggcataagcggatggtcactgaaatcgagcagatcattgagaagtggcataagaaaacggctccctgttgtggaagccgttatagtgcctcagtttaaggatcggtcaactaatccttaactgatcggcattgcccagaaggggccgtttatgttgccagacagcgctactgattaagcggattttttcgcttttttctcagctttagccggagcagcttctttcttcgctgcagtttcaccttctacataatcacgaccgtagtaggtatccagcagaatctgtttcagctcggagatcagcgggtaacgcgggttagcgccggtgcactggtcatcgaatgcatcttcagacagtttatccacgttcgccaggaagtctgcttcctgaacgccagcttcacggatagatttcggaatacccagttcagctttcagcgtttccagccatgccagcagtttctcgatcttagcagcagtacggtcgcccggtgcgctcagacccaagtggtcggcaatttcagcataacgacggcgagcctgcggacggtcatactggctgaatgcagtctgcttggtcgggttgtcgttcgcattgtagcgaataacgttacaaatcagcagggcgtttgccagaccgtgcggaatatggaactgggaacccagtttgtgcgccattgagtgacatacacccaggaaggcgttcgcaaacgcgatacccgcgatagtcgctgcactgtgaacacgttcacgcgctaccggatttttagacccttcgtggtaggacgctggcagatattctttcagcagtttcagtgcctgcagagcctgaccatcagagaactcagatgccagtacagaaacataagcttccatggcgtgagttactgcgtccagaccaccgaaagcacacagggacttcggcatgtccataaccaggttggcgtcgacaatcgccatatccggagtcagcgcatagtctgccagcggatatttctgaccagtagcgtcgtcagttacaaccgcaaacggagtgacttcagaacctgtaccagaagtggtggtgacagcgatcattttcgctttcacgcccattttcgggaacttgtagatacgtttacggatatccataaagcgcagcgccagctcttcgaagtgagtttccggatgttcgtacataacccacatgatcttcgcggcgtccatcggggaaccaccacccagcgcgataatcacgtctggtttgaaggagtttgccagttctgcacctttacgaacgatgctcagggtcgggtccgcttctacttcgaagaagacttcagtttcaacgcctgctgctttcagtacggaagtgatctgatcagcataaccattgttgaacaggaagcggtcagtcacgatgagcgcacgtttgtggccatcagtaatcacttcatccagcgcgattggcagggagccacggcggaagtagatagatttcggaagtttgtgccacaacatgttttcagctcgcttagcaacggttttcttgttgatcaggtgtttcggaccaacgttttcagagatggagttaccaccccaagaaccacaacccagagtcagggaaggtgcgagtttgaagttatacaggtcaccgataccaccctgagacgctggggtgttaatcaggatacgcgccgttttcattttctgaccgaagtaagaaacgcgagccggttggttatcctggtcagtgtacaggcaagaggtatgaccgataccgcccatagcaaccagtttctctgctttttctaccgcgtcttcgaaatctttagcgcggtacattgccagagtcggggacagtttttcatgtgcgaacggttcgctttcatcaacaacggtcacttcaccgatcagaatcttggtgttttctggtacagagaagcctgccagttcagcaattttataggctggctgaccaacgatagccgcgttcagcgcaccgtttttcaggataacatcctgaacagctttcagctctttaccctgcaacagatagccgccgtgggttgcaaaacgttcacgtacagcgtcataaacagagtcaacaacaacaacagactgttcagaagcacagattacgccgttgtcgaaggttttggacatcagtacagatgcaactgcacgtttgatatcagcagtttcatcgataacaactggagtgttgcccgcgcctacaccgatagctggtttaccggagctgtatgcggctttaaccatgcccggaccaccagtcgcgaggatcaggttgatgtctgggtggtgcatcagtgcgttagacagttcaacagaaggttgatcgatccagccgatcagatctttcggagcaccggcagcgatagcagcctgcagaacgatatcagccgctttgttggtggcatcttttgcacgcgggtgcggggagaagataatggcgttacgggtcttcagactgatcagcgatttgaagatagcagttgaagtcgggttagtggtcggaacgataccgcaaataataccgattggttcagcgatagtgatggtaccaaaagtgtcgtcttcagacagaacaccacaggttttttcatctttataggcgttgtagatatattcagaagcaaagtggtttttgatcactttatcttcgacgatacccatgccggattcggcaacggccattttcgcgagtgggattcgagcatctgcagcagccagagcggcggcgcggaagattttgtctacttgctcttgagtgaaactggcatattcacgctgggctttttttacacgctctacgagtgcgttaagttcagcgacattagtaacagccataatgctctcctgataatgttaaacttttttagtaaatcatctgctcgaatacgagagtatagtcagtgcggtgatgatttgcttaacctatgaaaatcaaaagcttactcgcgctcacactcactgtgatttactaaaagagtttaaacattagagttattatctctaatgcgtcacttccaggtggcgtaagcaagattactcacttctgggtactgattacgtgatccaaatcaaatttttgcaaagctgacacctttcagcatcgcttttcgccattatagctaacagttaataaattgtagtatgatttggtggctacattagcatgttttgcacaactagataacaataacgaatgatagcaattttaagtagttaggaggtgaaaaatgctgtcaaaaggcgtattgtcagcgcgtcttttcaaccttatttatggctaacattatccggcttttgcttcggagctaaccgtgattcagaccttttttgattttcccgtttacttcaaatttttcatcgggttatttgcgctggtcaacccggtagggattattcccgtctttatcagcatgaccagttatcagacagcggcagcgcgaaacaaaactaaccttacagccaacctgtctgtggccattatcttgtggatctcgctttttctcggcgacacgattctgcaactttttggtatatcaattgattcgttccgtatcgccgggggcatcctggtggtgacgatagcgatgtcgatgatcagcggcaagcttggcgaggataaacagaacaagcaagaaaaatcagaaaccgcggtacgtgaaagcattggtgtggtgccattggcgttgccgttgatggcggggccaggggcgatcagttctaccatcgtctggggtacgcgttatcacagcattagctatctgtttggtttctttgtggctattgcattgttcgctttatgttgctggggattgttccgcatggcaccgtggctggtacgggttttacgccagaccggcatcaacgtgattacgcgtattatggggctattgctgatggcattggggattgaatttatcgttactggtattaaggggattttccccggcctgcttaattaattcctttcaaatgaaacggagctgccatgctccgtttacttcgtcattatttttactttgttcccgcgcagttatcaaaagcaaaaggaataggtaaaaatattcttctcaaattacagttagttataaggatttccttaactgcttctcctcaccatcatgttattttcgccacatcataatcctgggcttgctgaagaataattgaaatgatattagtaattccactgcctttggtagaggaaagtgctaaataataatcaattgttaaattattgtgcatttcactactggaactgtaatcagaaaagatagacatgcttagccaatctctatttgattgaattgaaagatgtttgttaaggcatggatgcaagctatagattctgatacggtcaataaaagagaattgcttaacaattttgcaaaatgtattggcgagtaagaaccgcatttggtactttccgggcaaccgccagacgattctttattggtaatgagaataattaacaattaaagagcgtcgcgaaagaataatgtgtctcgacaggggagacacagtacgaatcgacataaggtgatcgtctgaatcaccagaataaataaagtcggtgatagtaatacgtaacgataaagtaacctgacagcagaaagtctccgagcctgtgcagggtcccaatccgggattacacatgctggttaataccagtaattataatgagggagtccaaaaaacaatgaccaacatcaccaagagaagtttagtagcagctggcgttctggctgcgctaatggcagggaatgtcgcgctggcagctgatgtacccgcaggcgtcacactggcggaaaaacaaacactggtacgtaacaatggttcagaagttcagtcattagatccgcacaaaattgaaggtgttccggagtctaatatcagccgagacctgtttgaaggcttactggtcagcgatcttgacggtcatccagcacctggcgtcgctgaatcctgggataataaagacgcgaaagtctggaccttccatttgcgtaaagatgcgaaatggtctgatggcacgccagtcacagcacaagactttgtgtatagctggcaacgttctgttgatccgaacactgcttctccgtatgccagttatctgcaatatgggcatatcgccggtattgatgaaattcttgaagggaaaaaaccgattaccgatctcggcgtgaaagctattgatgatcacacattagaagtcaccttaagtgaacccgttccgtacttctataaattacttgttcacccatcaacttcaccggtgccaaaagccgctatcgagaaattcggcgaaaaatggacccagcctggtaatatcgtcaccaacggtgcctataccttaaaagattgggtcgtaaacgaacgaatcgttcttgaacgcagcccgacctactggaacaacgcgaaaaccgttattaaccaggtaacctatttgcctattgcttctgaagttaccgatgtcaaccgctaccgtagtggtgaaatcgacatgacttataacaacatgccgatcgaattgttccagaagctgaaaaaagagatcccggacgaagttcacgttgatccatacctgtgcacttactattacgaaattaacaaccagaaaccgccattcaacgatgtgcgtgtgcgtaccgcactgaaactaggtatggaccgcgatatcattgttaataaagtgaaagcgcagggcgacatgcccgcctatggttacactccaccgtatactgatggcgcaaaattgactcagccggaatggtttggctggagccaggaaaaacgtaacgaagaagcgaaaaaactgctggctgaagcgggttataccgcagacaaaccgttgaccatcaacctgttgtataacacctccgatctgcataaaaagctggcgattgctgcctcttcattgtggaagaaaaacattggtgtaaacgtcaaactggttaaccaggagtggaaaacgttcctcgacacccgtcaccagggtacttttgatgtggcccgtgcaggctggtgtgctgactacaacgaaccaacttccttcctgaacaccatgctttcgaacagctcgatgaataccgcgcattataagagcccggcctttgacagcattatggcggaaacgctgaaagtgactgacgaggcgcagcgcacagctctgtacactaaagcagaacaacagctggataaggattcggccattgttcctgtttattactacgtgaatgcgcgtctggtgaaaccgtgggttggtggctataccggcaaagatccgctggataatacctatacccggaatatgtacattgtgaagcactaatggcaatacgtggggcaggagtgtcctgctccacggtgtctgatttttatcgcattacagaaggcacaggccagaaggtagggcaatgttaaaatttattctacgtcgctgtctggaagcgattccgacgctatttattcttattactatttcgttctttatgatgcgcctcgcgccgggaagcccttttaccggcgaacgtactttaccgccagaagtgatggccaatatcgaagcgaaatatcatcttaatgatccgatcatgacacagtatttcagctacctgaaacaactggcgcacggtgatttcggtccatcgtttaaatataaagattattcggtcaatgacttggttgcatccagttttcccgtttctgccaaactgggagccgcagcatttttccttgcggtaatactgggtgttagtgctggcgttattgccgcattaaaacaaaacaccaaatgggactataccgtgatggggctggcaatgaccggggttgttatccccagttttgtggttgcaccattattagtcatgatatttgcgatcattttgcattggctgccgggcggtggctggaatggtggggcgcttaaattcatgatattgccgatggtggcgttgtcactcgcttatatcgccagtattgcgcgtattacccgtggctctatgattgaagtattacactccaattttattcgtactgcccgggcgaaagggttacctatgcggcggatcattttacgtcacgcattaaaacctgctctgttacccgtgctctcttatatgggccccgcatttgtcggcattattaccggttctatggttatcgaaaccatttatggtttgccggggattggacaactgttcgttaatggcgcattgaaccgtgactattccttagtgttaagcctgaccatcctggttggtgctttaaccattttgtttaatgccattgtcgatgtgctatatgcggttatcgacccgaaaatccgttactgatactggagctcgcgatgatgttaagtaagaaaaacagcgagacgctggaaaatttcagtgaaaagctggaggtcgaagggcgcagcttgtggcaggacgcacgtcgacgttttatgcataaccgtgcggcggttgccagtctgatagtgctggtgctgatcgcgttatttgtaatcctggcaccgatgctttcccagtttgcctatgacgatactgactgggcgatgatgtccagcgccccggatatggagtccggtcactactttggtactgactcatccggtcgcgacctgcttgtgcgcgttgcgattggcgggcgtatctcactcatggtcggtgttgctgcggcactggtggctgtggtcgtcgggacactttatggttcgctttccggttatctgggcggtaaagtggattcggtaatgatgcgtctgctggaaatcctcaactccttcccattcatgttcttcgtcattttgctggtgacctttttcggtcaaaacatcctgctgattttcgtggcgataggcatggtttcctggctggatatggctcgtattgtgcgtgggcaaaccctgagtctgaagcgcaaagagtttattgaggcggcacaagttggcggtgtatcgacatcgggcattgttattcgccacattgtgccgaatgtactcggtgtggtggtggtctacgcatcacttctggtgcccagcatgatcctctttgaatctttccttagcttcctggggttgggtacgcaagagccgttaagcagctggggtgcattgctgagtgatggcgcgaactcgatggaagtctctccatggttattgttgttcccagcgggattcctcgtggtgacgctgttttgtttcaactttatcggcgatggcttgcgtgatgccctcgacccgaaagatcgttaaggagtgcagccatgagcgtaattgaaactgcaactgtgccgctcgcacaacaacaggctgacgcactgctgaacgtgaaagatttgcgtgtcacctttagtaccccggacggcgacgtcacggcggtcaatgatttgaatttttccctacgtgccggagaaacgctgggtattgtaggtgagtctggttcgggtaaatcgcaaactgcatttgcgttgatgggcctgttggctgccaacggacgtattggcggatcggcaaccttcaatgggcgtgaaatcctcaatttgccagagcatgaactcaataaactgcgcgctgaacaaatctcaatgatttttcaggacccaatgacttcgttgaatccctatatgcgcgtcggtgagcagttaatggaagtgctgatgctgcataagaacatgagcaaagctgaggcgtttgaagagtcggtgcggatgctcgatgcggtaaaaatgccggaagcgcgtaaacgcatgaaaatgtacccgcacgaattttctggcggcatgcgtcagcgagtcatgattgcgatggcattgctatgtcgacctaagctactgattgcggatgaacccactactgcgctggacgtcaccgtacaggcgcagatcatgacgctattaaatgaactgaagcgggaatttaataccgccatcattatgatcacccacgatcttggcgtggtggcggggatctgcgacaaagtgctggtaatgtacgccgggcgcacgatggaatatggcaatgcgcgcgatgtcttttatcaacccgttcatccttattctatcggtttgctcaacgcggtgccgcgtcttgatgcggaaggtgaaacaatgttgaccatccctggtaatccgccaaacttgctgcgattaccgaaaggttgcccgttccagccacgttgtccacatgcgatggaaatttgtagtagcgcaccgccgctggaagagtttacgcctggccgtctgcgtgcttgctttaaaccggtggaggaactgttatgaatgctgtaactgaaggaagaaaagtcctccttgaaatcgccgatcttaaagtgcactttgaaatcaaagatggcaaacagtggttctggcaaccgccgaaaacgctcaaagccgtcgatggtgtcactcttcgcctgtatgaaggggaaacattaggtgtggtaggggaatcgggatgcggtaagtccacctttgctcgcgccatcatcggtttggtcaaggcgaccgacggtcatgttgcctggttaggtaaagagttgctgggcatgaagcccgatgaatggcgtgccgttcgcagtgatattcagatgattttccaggatccgttggcatcgctaaacccgcgtatgaccatcggcgagatcatcgctgaaccactgcgtacttatcatccgaaaatgtcacgccaggaagttcgcgagcgcgtgaaggcgatgatgctgaaagtcgggttattgcctaacctgattaaccgctatccgcatgagttctccggtgggcagtgccagcgtatcgggattgctcgtgctcttattcttgaaccgaagctgattatctgcgatgagccggtgtcggcgctggacgtgtcaattcaggcgcaggtggtcaacctgctccagcagctgcaacgtgagatgggattgtcattaatttttatcgctcatgacctggccgtggtaaaacacatttccgatcgtgtgttggtgatgtatctcggccatgcggtagaactggggacctatgatgaggtctaccacaatccactacatccttacaccagggcattgatgtcggcagtccccatacctgatccggatctggagaagaacaaaaccatccagttactggaaggggaattaccgtcgccgatcaacccgccttccggttgtgttttccgtacccgttgcccgattgccggtccggagtgcgccaaaacacgtcctgttctggaggggagtttcagacacgccgtttcttgcctgaaagtcgatccgctttaaacacaataagggctgacagttgtcagccctttttcacgccgaaagcgattatttattcccgccagatgatatggcaaagtttgtgatctttttcgcggcataacagaatgcgggcgaaaacatcgttgatttcaccatcttcactgtccgccagaccaatcaccacttcggcaaaaaagtccgggttcaaatcgaaatcaacatgttcctgccagtcttccgccggatcgaataactccgcgccgccgcgctcttcaaactgaagattgaacagcagaacatcagctggatcgagattgtcggcagccagttcgagaaaaatatcgtaggcctgctcaagcgtttcatcttcagtcaggcgattgtttagatccatatccatagtcactacctgtttaacctctgttggcgacgttttacagcaacgggctgaagaagtaaaacagtcgctcggcgacacgttgccataatggacgttttagccataaacgggcatcgagcagacgtgaacgcgaaatataatcgtcctgaacggcggcaaggtctgcaccaaaacctttatcgtcgattgccagagtaatctcgaaatttagccacagactccgcatatcaaggttaacggtgccaaccagacttagttcaccatcgaccagcacgctcttggtatgcagtaacccgccttcaaactgataaattttaaccccagcagccagcagttccgtaaagaatgcgcgactggcccagccgaccagcatcgagtcattttttcgcggaaggataatactgacatccaccccgcgctgtgccgccgtgcaaatcgcatgaagtaaatcatcgcttggcacaaagtagggcgttgtcatgatcaaatattcacgcgccgaataagccgcagtcaataatgcctggtgaatgagatcttccggaaagcctgggccagaagcaattgtgtgaatggtgtgaccgctggcctgttcaaacggcataatattgacatctggtggtggcggcagaatacgttttccggtttcaatctcccagtcgcaggaataaataatccccatcgcggtggcgatggggccttccatacgcgccatcagatcaatccattgccctacgcccgcatcttgtttgaagtagcgagggtcgaccatattcatgctgccggtgtacgcgatgtaattatcgatcatgatcatcttgcgatgttggcgcaggtccatacggcgtaaaaacacacgcatcagattgacctttaaggcttcgaccacttcaataccggcattacgcattagctcgggccacgggctgcggaaaaaagccacactcccggcggagtcgagcatcaatcggcaatgaatgccgcgtcgcgcagcggccattaatgattcagccacctggtccgccatgccgccgggctgccagatataaaacaccatctcaatattatggcgcgcgagctggatgtcgcggattaacgcctgcatcacatcatctgactcggtcatcagttgtagctgattccctttgaccccagcgatcccctgacgacgctcgcaaagcttgaataatggcgcagcgacactgctattttcttcggcgaagatatgcttacaggctttaaggtcgttaagccattttgcggtggaaggccacatcgctctggcgcgctcagcgcggcgtttgcctaaatggagctcgccaacggcaagataggcaataattccgactaacggcagaatgtaaataatcaacagccaggccatcgcggagggaactgcgcgtcgtttcattagaatgcgtaaagttacgcctgcaatgagcaaccagtatcccagaatggccaaccaactcaccaacgtataaacggttgtcatagattagaaatccttttgaaagcgcattgttatgagtttacgcatatggattcatctggcaaataaaaacgcgggaaaagcactggtcagcgtcgggggcgggggtataatgaccattctgttattgcatagagtagttaacatgaagcggagtagaacggaagtggggcgctggcgcatgcagcgtcaggctagccgacgtaaatcgcgttggcttgaggggcaatcgcgccgaaatatgcgtatccacagcatcaggaagtgcattctaaacaaacagcgtaactcgttattgtttgcgatctacaatatctaaatgtactgggcaccattgcggtgcccaataagtttactcctccgtctttaaactctatttttgcgccgattctttactgtcagctttcgtttcttgttcatcgttatcgctgaaaataccatgacctgagttcaacaacattgaaacgagcatatcattattaatctcttcaccatttaaaactcgcgccagaatttcgctgccaaacagttgcggtgagagaatgatatccggatgtaccatcttaatcttattcaggtttttgctatcactgacggcgagaactgttttgacatcactgctcatatcttttgccgagagtacaacaaacgcgttatctgcatcgttatcactcagcgccagaatggcccggcaacgatcgattcccgctttctttaatacagaactgtcattactgtcaccggggataacatcagcattatcgcctaagcgttgctcaagttgcttgatatcatcttcaggcaagttgctgataaccgttacgttttgtccgcgttgattcagttgcaggatcgtattgatggcgagaatcgaatgtccgcaaacaataaaatgatctttacgatgcattgtatgattgtttccttttacaagtttgttgaatcccccgcggataagcggaccaaaaattgaggtcatagatgtggcaaaaacggtaatgccggaaataatgaccgaaatagtgaacaatcgtgctgattcagaaacagggacaatatcgccatagccgacggttgacatggtttctatcgaaaaatagaacgcggtcatcaaactttctattcgcggattaaaaccttcgcttaaataaagcgcaccgtaggttgagtaaaacagtaatgtcgtgaaactaataaatgcaaaaattgtcccggctgcggcgctactgtgggagaagtctttgcgcagtatcagcaaaaacaccagcgtaaaaatgcaaaatccaatactaaatttcagccagggataaaaatgcagggtgtaaattagcgctatcaacaacaaaatgatactgattgcccatgcgagctttgcccggaacagtaagccaatggagttcaggacaagaaagacgccgagcataaagagtggggcgtttgccagcaaggagagatccaactctgaaaatgctttgatatggaaaatatcaagcaaattgaccgacataccatagattgttttaaaaataagcaatccatttaaaaagacggccagcgcgagaatgtcgtgccgaagggtcacccataaatttgttgctgtttgtttgaatgtagcccagtgactcactgatacctctgtaaccacaattttgtttaattatcttagcgtgcacattttctgaacatacatgcagcgcgtgaatgtgttaaacaatagtagatgactttatccgcagtaatcaaaggatttgagcgagcaactgtacctcaggaaaggtcatttttcctgaatatgctcacatcatataaagaaatacagataaagttattatctgcttgtggtggtgaatgcactgaccggctataaggaaaggccaaacaagaacacggttgcaaaaaccgtgcccttaaatattgaatctctattcagaacactttcttaaatggtttcactgaaacgtgttcatagactcctgccgctacgtacgggtcagcatcggcccaggcctgagctgcttccagcgattcaaattcagcaataacggttgagccagtaaatcccgcagcccctggatcgttactgtctaccgctggcattggaccagctgtcaacaaatgaccttcatcatgcagtaactgtaaacgtgctaaatgtgccggacgaacggaaaggcgtttttcgaggctatcagctttgtcttgagcgtaaataacatacaacacgggcacaactccttgttcgggaaagttgtaaagtacgttatttgaaagggcgaagatctgcaacggaaagatgatgtctttgttaaggccatgcataaagtaagggtaattacgccaaaaatgacattttcactgatcctgatcgtcttgccttattgaatatgattgctatttgcatttaaaatcgagacctggtttttctactgaaatgattatgacttcaatgacccttgatttacctcgccgcttcccctggccgacgttactttcggtctgcattcatggtgctgttgtggcgggtctgctctatacctcggtacatcaggttattgaactacctgcgcctgcgcagccgatttctgtcacgatggttacgcctgctgatctcgaaccgccacaagccgttcagccgccaccggagccggtggtagagccagaaccggaacctgagccgatccccgaaccgccaaaagaagcaccggtggtcattgaaaagccgaagccgaaacctaagccaaaaccgaagccggtgaaaaaggtacaggagcagccaaaacgcgatgtcaaacccgtagagtcgcgtccggcatcaccgtttgaaaatacggcaccggcacgcccgacatcaagtacagcaacggctgcaaccagcaagccggttaccagtgtggcttcaggaccacgcgcattaagccgtaatcagccgcagtatccggcacgagcacaggcattgcgcattgaagggcaggttaaagttaaatttgacgtcacgccggatggtcgcgtggataacgtacaaatcctctcagccaagcctgcgaacatgtttgagcgtgaggtgaaaaatgcgatgcgcagatggcgttatgagccgggtaagccaggcagtgggattgtggtgaatatcctgtttaaaattaacggcaccaccgaaattcagtaagcataaagtcaaaagcctccgaccggaggcttttgactattactcaacaggtaaggcgcgaggttttccttcaggatcaaccgcgacatacttaaataatgcttctgtcgctttataccgttgcccgattggttcagacgctacttttttcacccacacttcaatattaatgctgaccgatgtcgtccctttctggacacagcgtgcatagcagcacaccacatcgccgaccgcaaccggccgtaagaaagtcattccttcaacccgcacagtcactacgcgaccgtgggcaatttcttttgccagaatagcgccgccaatatccatttgtgacattaaccaaccaccaaagatgtcaccattggcattggtatcggcgggcatggctaaagtacgtaaaacaagatcgccctgagggacgttatgtgttgtagacatggtaaaaccgacttaaaaggaaaatcacaggcgcgatgctactatgattttcctgaggagaacagaggagatacagcgccagccccgaaggactggcagtctggttaggatttatcttcctgcggcatgtggcggtagatatagataccgcttaacaatgtgaagattaaggtaagggcggtcaggccaaagactttaaagttgacccaaatattttgcggcagccagaatgcgatgtagatgtttgccagaccgcaaaggataaagaaaacagcccaggccagattcagcttcgaccataccggttgcggcagcgtgagttctttacccagcatccgctgaattagcggctttttcatcacccattggctgactaacagggctcccgcaaatagagcataaatgactgtaaccttccatttaataaactcatcattgtggaagaacagcgtcaagccaccgaagacgaccaccagaacaaaagtgatcagggccatcttctcaaccttacgaaagcgaacccagctatagataagcacaatcgccgtggcgacgatcagcgccgcagtagctgcatagatgtcataaatcttgtaaaacgcgaaaaagacaaccagcggtaaaaaatcaagaaactgcttcattttacgattccgtaatcaaatgcttaaggttattggcgaatcaacatatacaggcggaacagatagatgagcaatatggctgaaatcaggttgctcaaggtgttcgccagtacggcaccaatttccggggttaatgcggcaaaagaagaggcaaaaagcagcaacagtgtttttgccagcaaccagctcagtactgcgggtgccaccagacgcatattcgcccaagtcagccgcatactgctacgcatcgaggcaaaaatgcccattttgtcctgtaccagcatcaccggtgccagggccagcaaaatggccatgataattcccggaacgaccaccagcatgatgccaatctgtactaaaagggtagtcagaaaaatcagaataaataacttgggcaatatcggcgcactggcaccaatagctcgcagcgcactgactctctgacccgcagacaccagctggataattaatattacgcctccggcgagaatggcgttaccgatcaatcctgaaaaagtggaagccgctgaagcttgcagcaaaatttgttgctgttccggtgacatattctgaaccaggtcgaacaacccactactgccgctaacgggtacgccgtcattgagctgcgcaagctgtgcatcactgggtgagaaaacatgccctaacaccactgtgataaacgcacatagcaacgataccaacagaatggtcataaattgattacggaagaaatttccggtgtcacggtatacggactgcgccgtgatagacatgcactctccttgagttttatgcaggtgttaattagcgggcaattgtaccctggttaagcctcgggtggcagcatcaggtcttgtatggaaaagcatatctttgtaaagcggaggtaattgctggccttcaggcatgggcaaatcgcggcaagtggcgaccgagttaatatttgcgtagcgaaaatatttaaaaattgatttaaatcacattaaccaggattctcaatgcaacttctaaattaatccagatcaataaagggtgaattatcatatgtaatgtgatctatgtaggatcatttgttactccaatgtaggtatattcgtcacgtttttataaccataacgacggagcggatatgaaaaagttaacagtggcggctttggcagtaacaactcttctctctggcagtgcctttgcgcatgaagcaggcgaattttttatgcgtgcaggttctgcaaccgtacgtccaacagaaggtgctggtggtacgttaggaagtctgggtggattcagcgtgaccaataacacgcaactgggccttacgtttacttatatggcgaccgacaacattggtgtggaattactggcagcgacgccgttccgccataaaatcggcacccgggcgaccggcgatattgcaaccgttcatcatctgccaccaacactgatggcgcagtggtattttggtgatgccagcagcaaattccgtccttacgttggggcaggtattaactacaccaccttctttgataatggatttaacgatcatggcaaagaggcagggctttccgatctcagtctgaaagattcctggggagctgccgggcaggtgggggttgattatctgattaaccgtgactggttggttaacatgtcagtgtggtacatggatatcgataccaccgccaattataagctgggcggtgcacagcaacacgatagcgtacgcctcgatccgtgggtgtttatgttctcagcaggatatcgtttttaattccgcacaaaaacgaccccgtaatatacggggtcaataaggacatggtataaagggtattatttcttcgcttctacgccatcagtttcagagcgaattaaaaatttctcagttgtttgcggaatattctgaatcagccagtcggccatttgcttttcctcatttaaaatcgcttcgatggttggaattgaagctgtatcaccggcattttttgctgctgctaatagtgaggtgtaacaggcgatttcaaattgctcgaagacatatccgctaatagagcctttgactatttcatcagaagggaatataccaccgattgactgcccaagcgcagccattttactcatggaatctttaatgactgaacgtgaaatgtcattacgatcaagaatagtttccagttgaacaatctggtttttggtttcactaagatgttgttcaatacgagcgcgtagttcaggataattatctatacggctggccatggattcaagcatagattcggcttgcttttccattgcgtgggcgtcacgtaaccagtcatgataatgttcaatacgattcatgaaaatgtcctctttataaaatgactaaaagttaaaattcatatttcaggctttattttcggctttcttatttacgttattaatggccagatcagtcagtttgatgtcggtggccttttcttcttccagggtttctttcagaagcttcgctgctttacggtaacctaattgttcagccagcgtcgctaatgtcccgtaactggcaatctcataatgctcgactttctgtgctgcggcaatcagtgcggcatcacgcacttcgtttttctcggtactttcgatgacctcattagcttcttcaataagaccttccattgccacacatttcatgcgcttaattttcaggttcgattcggactccacaacttgatcaatacgttcaatctgtccatgagtttcctcgaggtgcgcatgaaaagcctgacttaatttttcatttgatgttgctcttgcgagttttgccagtgcccgggttaattgtttttctgcgctgtaggtatctgaaagcaggtgaataaatacatcttcaatggtcttcatattcatatttttctccagtgaaatcactgcgagccatacggcccgcagatgcaattatctttatcagctgatattaataattaacggtgaatcaggatttgcctgatttattaccaccgctttgttgaccgccttttttacccgcttcagatgcgcgttgcggatcatttttaaaattaccgccgctatgctgaccgcctttacggcctgcgtcggatgccttctcacggtcttcggcgaaatttcctgaaccaccacgatgttcggccatgttatttctcccgttgcgttgcattgtttcattaatatgagtgttgtgtgtcgacactcattaaaattagtcgctaatgagaattagtcaaattaagcgcaacgagaagatagagggaaaatatattttgaggaacattctggatatattaacaattacctgaggaataagtgacttagagaaaattattgattttactggtgttatgttgcgggattaatttgtttgattatattactgttgggcggaaaaatgacgtaagttgacgttcgaccggggtaagcgaaacggtaaaaagataaatattaaatgaatttaggatttttccggcttcattaaagaaagttaaaatgccgccagcggaactggcggctgtgggattaactgcgcgtcgccgctttcatcggttgtacaaaaactttcagtgccgccagcattttctctggctcattaatatgttgctcgatgattttaacaatggccgaaccagaaatcgcgcccgcagctcctgcatcaatcgctgcttttacctgatccggggcggaaataccaaatccctgcaatggaggtgcagcgttgtactctttcagcttcgcaaccagatgattgaggggtaacgcggcgcggttttctgcgccggtcacgcctgctcgtgacagcaaataggtgtaaccacgaccgtaagaggctatctggcgcagcaggtcgtcatcggcatttggcgggcagatgaagataggtgcgacattatgacgcaacgcggcctggcggaagggcgcggactcttcaactggcacatcggcaaccagcaccgaatcgacgccgactttttcgcactgggcataaaactcatcaatgcctttgttaaacaccagattggcatacatcaacaggccaatgggaatggtcgggtgtttctggcgaatcagtgccagcatttcaaaacattgtgccggagtcacacctgccgcaaaggcgcgcagagtggcgttttgaatcgtcgggccatccgccagtgggtcggagaaggggatacctaactccagcgcgtcagcaccggcttcaattagcgtatcgataattttcaatgactgctcaatgcccggatcaccgagcgtgacgaaaggaacgaatgcgccttctttgcgctccttcaactgggcaaacagagattcgtagcgttccatcagatttcccctcgtgctttcaaaatatcgtgaacggtgaagatgtctttatcgccgcgaccggaaaggttaaccaccagtagctgctctttatccgggttttcgcgcatcattttcaacgcatgggccagggcgtgggaggattccagcgccgggatgatcccttcgtgcaggcacagcgttttgaaggcttcaagggcttcatcatcggtaatagacacgtaatcagcgcgtccagtgctgttaagatacgcgtgttgtgggccgacagacgggaaatccagtccggcggagatggagtaagattcttcaatctgcccgtcttcggtttgcatcatcggcgctttcataccgaaatagatacccacgcgaccatgttttagcggtgcgccgtgctcgccagtttcgataccgtgaccacctggctccacaccaatcaggccgacgttggtttcattgatgaaatcagcaaacatgccgatggcattcgaaccgccgccaacacaggcgataacggcatccggcaggcgaccttctctttccagaatctgcgctttggtttcttcgccaatcatccgctgaaactcacgcacaatggtcggataaggatgcgggccagctgcggtgcccagcatatagtgcgcggtttcgtaactaccggaccagtcgcgcagcgcctcgttacaggcatctttcagcgtcgcggaaccgctatgcaccgggatcacttccgcacccattaagcgcatacgaaaaacgttaggcgactggcgttcaacgtctttggcacccatataaatacggcatttcaggccgagcagggcgctggcaagggccgacgccacgccatgctgaccggcaccggtttcggcgatgatttcggttttacccatccgcttcgccagcaacgcctgccccagcacctggttagttttatgcgcgccgccgtgcagcaaatcttcacgcttgagatacagcgtggtgttcgtcccggctgtaatgttctggcatttggtcagcgcggttggacgcccggcatagtttttcagcaggtcgttgaactgagcctgaaattcaggatctttttgcgcactgacaaaagcttcttccagctggcgcagagcaggcatcaggatttgtggcacgtacatgccgccaaactcaccaaaataggggttaagtaatgttgtcattgttcctttccttaatatgcgcgcagcgtctggaaaaccgaggccaaaagacgtgcgtctttgatgcccggttgcgactctacagcagaattaaaatcaagtccggcgcagccggtttgtgccgcttccacgcagttatctgcgcctaagccccccgccagcagaacgttgccaagcgattgaccatttaatagtgaccagtcaaaacgttgcccgcttccaccctggccgttgtctaaaacatatttatcaacgtgctgaaactcgcgggcgggcagggtttcaccgacgcttaatgctttccagatggcaacatgtgctggcagagcttcacgcagcgtatcgatatacagctgttcttcattaccatgcagttgcactgccgccagcgataacaccttagctttgtccaccacatcggcaatatcgtgattgcggaacacgccaacatactgcaacggtgccgcagccatcacttcctgcgcctgttcaacgttgacgcaacgcggtgatgtcgcaacaaaaatcaacccaccgtaaatcgcgcccgcgtcataagctgctttagcatcttgcccacgcgtcaggccgcatactttattctcacccagcaacacccggcgcacggcggcgtgcaaatcgtcatgggccatcaacgccgaaccaatcagaaaaccgttagcgaagtggcttaactcgcgcacctgagcgtaagtattgatgccggattcgctgattaccgtcacgttgtgccccagtttcggcgcaagctcgcgggtacggttgagatcaatcgacaaatcacgcagatcgcggttgttgatgccaacgacctttgctcccaatgcaatggcgcgctcctgttcctcttcattactgacttcggtcagcacccccatctccagactgtgagcgacggcggcaagctggcgatattggtcgtcatccagtactgaaagcattaataagcaggcatcggcctggtaatagcgcgccagatagatctggtaagggtcgataatgaagtctttacataaaatcggctgcggggcgatttggctgacgatggggaggaaatcaaagctcccctgaaaatatttctcatcagtcagcaccgaaattgccgaagcgtaatgtttataaatggcggcaatgcgtgctggatcgaaatcatcacggatcacgccttttgacggcgacgctttcttgcactccagaataaacgccgtgcgcgcaccctgtagcgcatcataaaaatgtcgcgtgctcggctgaacctcattctgaaaactggccagcggttgctgctgtttgcgggcttctacccaaatcgccttgtctgcgacgattttcgctaaaacggtttgcatcatttaccctcgtgccgccagtgcggtgactctgtcgtaagcggaaccactgcgcagtacctcaagaacggtttgcgcattggcttgcagatcttcatggccatgcaggcgcattaacatggcgacgttcgcagcgacggctgcttcatgggcggcgtcgcctttaccttgtaacaaacgtgttaaaatgtcacggttttcttccggtgttccgcctgccagttgctcctggtggtagggtgtcaggccaaagtcttctgcggtgagctgatagcttttaatttcgccgtcatgcagttcggcaacgattgtcggcgcgtgtaatgaaacttcatccatcccgccgctgtgcaccaccgccgcgcgttgataccccagcacgcgcaaggtttcggcaatcggcagcaccagttccggactataaacaccaattaacgccagcggcggatgcgccgggttaatcaatggccccagcacattgaacagggtgcgggttttcagttgctggcgaaccggcatcgcgtggcggaatccggtgtgatacttcggcgcaaagaggaaacatacacctaactcatccagcgcctggcgcgatttatcggcgttcatatcaagattaataccgaacgccgccagcagatcggacgaaccagatttactggagacgctacggttgccgtgtttcgccactttcagcccacaggccgcggcgacaaacgcactggcggtagaaatattgatactgttgctgccgtcaccgccagtaccgacgatatcagcaaacagataatccgggcgcgggaacggcgctgcgttttccagtagcgcggttgctgccccggcgatctcgttcgggtgctcaccgcgaattttcatgctcaccagcgccgccgccagttgttccggcttcagctcgccacgcaccaccgctgaaaacagctggtggctttcttgttggctaagcgtctgcgcctgatacagtttttccagaatcggttgcagcgtgttggctggctctagtttctgctgcgcccaggccagcgtttgttccagcaggcgagcgccctgggtggtgagaatggattccggatggaactggaatccacaaacgcgatccgcatcgtgacgtactgccatcaccatgccattaaaatgggcgttgatggttaaaccggccggaatgttactgccaaccagcgagtgataacgcgccaccggcagcgggtttgttaatccggcaaacatcgcctgaccgtcatgttcaatgctggaggctttaccgtggagaatttcgcccgcctgaccgacatagcccccgtaagcttcgacaatcgcctgatgtccgaggcaaatgccaataatgggcagcttgccacgcaagcgggtgaggagttccggcatacaaccggcttcgctcggcacaccggggccaggagaaagcatcagcaccggattgctcatggtcgccaggcgttcaattaaggtttgcgccggaatatggttgcggtaaatcaccacgttatgcccattgctgcgcaactgatctgccaggttgtacgtaaaagagtcgatattatcgagcagcagaatgtcagccatcagaaagtctcctgtgcatgatgcgcggtggcaatagcgcgcagtacagcgcgggctttattacgggtttcgtcggcttccgactgcggaacagaatcaaggactacgccagcaccggcttgcacggtggcgatactgttttccaccagcgccgagcggatcacaatgcaggtgtcgagatcgccatgcgcggtgaaataacctaccgcgccgccgtagctgccgcggcgacgaccttcagcctcggcaattaactgcatagcgcgtactttcggcgcaccgcttaacgttcccatattcatacaggcgcggtaagcgtgcagggcgtcgagatcgtggcgcagctcaccgaccacgcgggagaccaggtgcatcacgtaagagtaacggtcaactttggtaagatcggcgacgtagcggctgccgggggtgcaaatgcgtgccagatcattacgggcgagatccaccagcatcagatgttcagaaagctctttatgatcggtacgcatttccagttcgatgcggctgtcgaggtctctgtccagtgaaccatcggcacgacgaccgcgtgggcgtgtcccggcaatcgggtagatctcaatctggcggctggtggcgtcatatttgagcgaactttccggcgacgcgccaaacagggtgaaatcattatcctgcataaaaaacatgtacgggctgggattactctttttcagcacgtaataggccgccagcggtgacgggcagggcagagagaaacggcgagatggcaccacctggaaaatttctccagcgcgaatcgctttttgcaacaaacgcactacgccaccgaactcttcatcgctctggttacattcacaacgcatatgcggcacggaaaccaccggcagcggtggcgcggtttcggtcagttgctggcgaagatcgttcaggcgagcagtgagacgttgtttttcttcttcattcggagcaaacaggctggcctgaatgcgggtgctttttttctgatggtcaatcaccatcagcgtttcagcgagataaaaacagaaatcagggcagttattttccgctgacagttgcggtaaatcttcaaaccccgccacaaggtcataagagaacaggccgccgaagaacatggcttctcgttcttccttcggtacattcaacagattctgcaataagcggaaagcgtcaaaaaccgaaagggagcataagcgagcgtcttcatccagcagtggactaacaggggggaagcgcagcacacggcagtttggtaattgttcattttccacacccgcaggcagggcgttatccagtagtgtcagcagggcttcgccgttgccggaaagggactggattgtgacagtgtcacctaaagctgtaatgcgtagcgcactgtctactagcagcaggctttttaaatcatctttgctgtcgatatctgcggattccagcagcagcgttgccggacgatcctcacacaattggtgaaaaagcgcggtgggattgtcgcgataagcgccttcgcaggttagcagttcgagagtcggtttttgtgtttgcattgttattctctaattttgttcaaaaaaaagcccgctcattaggcgggctgggtatctgattgctttacgcatggtgaatacactgcccgtttcaggaagtgcgccaccaagctttcagtacgaaaattgctttcattgtcgataccctttttacgtgaacttgcgtactagttaactagttcaatgattaattgtcaacagctcatttcagaatatttgccagaaccgttatgatgtcggcgcaaaaaacattatccagaacgggagtgcgccttgagcgacacgaattacgcagtgatttacgacctgcacagccataccacagcttccgatggctgcctgacgccagaagcattggtgcaccgtgcagtcgagatgcgcgtcggcaccctggcgatcaccgaccatgacaccacagctgcaatcgcgccagcaagagaggaaatttcacgttcgggactggcgctgaatcttattcccggcgtggaaatttccacggtctgggaaaatcatgaaattcatattgtcgggctgaatattgatattactcatccgctaatgtgtgagttcctcgcgcagcagacagaacggcgcaatcagcgggcgcagctgattgccgaaagacttgaaaaagcgcaaatacctggggcgctggaaggcgcacaacgactggcgcagggcggcgcagtgacgcgcggtcattttgcgcgtttccttgttgagtgcggcaaagccagttcaatggcggatgtctttaaaaagtatctggcgcgcgggaaaaccggatacgttccgccacagtggtgtacaatagaacaagctattgatgtcattcatcattctggcggtaaggcggtgctagctcatcctgggcggtacaatcttagtgctaaatggctgaaaagattggttgcgcattttgccgaacaccacggtgacgcgatggaagtcgcgcagtgccagcaatcgcccaatgaacgtacccagctggcggcccttgcgcgtcagcatcatttatgggcatcacaaggatctgattttcatcagccatgcccgtggatcgaactgggtcgtaaactctggctgcccgcaggcgttgaaggcgtctggcagctatgggaacagccgcagaacaccacagagagggaattatgagccagtttttttatattcatcctgataacccacagcaacgtctgatcaaccaggcggtggagatcgtgcgtaaaggcggggtgattgtttatccaactgattccggctatgcgctcggctgtaaaattgaagataaaaacgcgatggagcgtatttgtcgtattcgccagctgccggacggtcacaactttaccctgatgtgtcgcgatctttctgaactctcgacctattcatttgtggataacgttgcgtttcgtttaatgaaaaacaacacgccgggcaactataccttcatcctgaaggggacgaaggaagtgccacgccgtctgttgcaggaaaaacgcaaaaccatcggtatgcgtgtgccttctaacccgattgcgcaggcgttgcttgaagcactgggcgaaccgatgctttccacttcgctaatgctgccaggcagcgaatttaccgaatccgatcccgaagaaattaaagaccgtctggaaaaacaggtagatttgattattcacggcggctatctcgggcagaaaccgacaacggttattgatcttaccgatgatacgccggtcgtggtgcgtgaaggcgtaggtgatgtgaagcctttcttataacaaattgcgttccacggatggaagactatggcagggaagtttcgctgcattttgctgttgatagcagggctgtttgtatcatctctaagttatgcagaaaacacggagatcccttcttatgaagaagggatttcgctctttgatgttgaagccactctgcaaccggatggggtgctcgacatcaaagaaaatattcattttcaggcgcgaaatcagcagattaaacacggattttatcgtgatttaccacgactctggatgcagcctgatggggacgctgcactgctgaactatcatattgttggcgtcacccgtgatggtattcctgaaccctggcatcttgactggcatatcgggttaatgattattgtcgtgggcgataaacaacgtttcttgcctcaaggcgactatcattatcaaattcattatcaggttaaaaatgctttcctgcgtgagggagattcagatctgttaatctggaacgtgactggtaaccactggccgtttgaaatctataagacccgattttcactcaagttccctgatatcgcgggtaatccatttagcgaaatcgatctctttactggagaagagggcgacacatatcgaaatggccgcatctttgaggacggaagaattgaatccagcgatccgttttatcgtgaagatttcacggtactctaccgctggcctcacgctttactcagcaatgccccggctccacaaacgacgaatattttcagccatattcttttaccctccacgtcatcgttgttaatttggtttccgtgtctattcctggtttgtggatggttatatctctggaagcgcaggccgcaatttacgccggtagatgtgattgaaaccgatgtcattccgccagattacacgcccggcatgttacgtctcgatgcgaagctggtttacgacgataaaggtttctgtgccgatatcgtaaatctgatcgtgaagggaaaaattcatctggaagatcagtatgataagaaccagcaaatcctgatttgtgttaatgaaggcgcgaccagaaataatgaggtattactgcccgcagagcagttattactggaagcgttatttcgtaaaggcgataaggtcgttcttacggggagacgcaacagactcttacgcagggcatttttacggatgcagaaattttatctgccgcgtaaaaagtcttcgttttaccggcctgatacgtttttgcaatggggtggactggcaatattggcggtcattctctgcggtaacctgagtcccgtaggttgggcaggaatgagtctggtaggcgatatgtttattatgatctgctggattattccttttttattttgttcccttgagcttttatttgcccgcgatgatgacaagccttgcgttaatcgtgcaatcatcactttgtatttaccactgatttgttcaggcgtggccttctattctctctatatcaatgtcggagatgtattcttttactggtatatgccagcgggttattttagcgctgtttgcctgaccggttatctcactggcatggggtatatttttctgccaaagtttacccaaactgggcagcaacgttatgcccgcggtgaagctatcgttaactatcttgcgcgtaaagaggcagcaacacacagtggacgtcggcggaaaggggaaacacggaaactggattacgcgttgctaggttgggctatatcggcaaatttggggagggaatgggcgttacgcattgccccttcgctttcttcggcgattcgcgctccagagattgcccgtaacggcgttttattctcattacagacgcacctaagttgcggggccaataccagtttgttggggcgaagttattccggtggtggtgctggcggcggcgcgggtggcggaggcggtggtggctggtaattaagctgatgttaatcgaaacaagctttaaccataaagatagtgtagtatgttgcgcctcaaagccaggccgataaacgtcgagtcgtttacttaaggcctgaagagttcaaacagactttactatcagtgagtcagatgtaagttctgactcactgttgcacaaaagcatatcagacgcctgggaaggcgacaccaaaaggaagctctatgagcgaaaagctacagaaagtgctggcgcgtgccggccacggttctcgccgtgaaatcgaatctattattgaagccggtcgtgtgagtgttgatggcaaaattgctaaactcggcgatcgtgttgaagttacccctggattgaaaatccgtatcgatggtcacctgatttcggtacgtgagtccgctgaacaaatttgtcgcgttctggcctattacaaaccggaaggtgagttgtgtacccgtaacgatccggaaggacgtccaacggtgtttgaccgtctgccaaaactgcgtggcgcacgctggattgccgtgggtcgcttggacgttaatacctgtggtctgctgctgttcaccaccgatggtgaactggcaaaccgtttaatgcacccaagccgtgaagttgaacgtgaatatgccgtgcgtgtatttggtcaggttgacgacgcgaaactgcgtgatttgagtcgtggcgtgcagttggaagatggtccggcagcttttaaaaccatcaagttcagcggcggcgaagggatcaaccagtggtacaacgtgactctgaccgaaggccgtaaccgtgaagttcgtcgtctgtgggaagcggttggtgtgcaggtgagccgcctgatccgtgttcgttacggtgatatcccactgccaaaaggtctgccacgcggtggctggacggagctggacctcgcccagactaactatctgcgcgaactggtggagctaccgccagaaaccagctctaaagtcgctgtagaaaaagaccgtcgtcgcatgaaggcgaatcagattcgtcgtgcggtgaaacgtcacagtcaggtgagcggcggtcgtcgttctggcggacgtaataataacggttaatcaaagtatgccggacgtcatatccggcatttttacagattaataatcgatccctatctgcgcttttacaccggcatcaaacgcatgtttgacggggcgtaattcacttaccgtatctgccagttcaagaatatcccgatgacaaccacgacccgtgataatcaccgtctgttgatgtggacgttcatttaacgcctgcaccacttcttccagtggcaaatagtcatacgccaccatatacgtcagttcatcaagcaaaaccatatccagtgaggaatcagcaagcatccgctttgcatgttgccagacttcgcggcaggcggcggtatcagactcgcggttttgtgtatcccaggtaaagcccgttgccatcacctgaaactcaacgccatgtggctccagcagattgcgttcgccattaggccaggtgcctttaataaactgcacgacgcctactttttttccgtgaccaactgcgcgtgttgccgtaccaaatgccgcggtggttttgccttttccattgccggtaaagacgatgataataccgcgttcatcctgggcctgggccacacgagcatctactttttctttcactcgctgctgacgctgttggtagcgttcatcactcattgggaaattcctggtttacggcccggttgggcgtcaaaggtcatgccggttttacggcggctgtcatcgcccatcagccagaggtagagcggcatgatatcagcgggtgttttaagtttctgtggatcttcggtcgggaaggcgctggcacgcattgcggtgcgcgtaccgcctgggttaatgcagttgacgcgcaggcgctgctgatattcatcggccagtacctgcatcatcccttcggtggcaaatttcgacgctgcatatgcgccccagttggctcgtccctgacgtccaacgcttgatgaagtaaagaccagtgaaccggcgtccgatttgagtaataaaggaagcagtgcctgggtgagcataaaggtggcattaacgttgacctgtatgacgtcctgccagacctgtggattttgttcgctcattggacaaacatcgccgagcaatccggcattatgcaaaacaccatccagacgcggataattaacggcaatgcgctgtgccagttgttggcaatcttcggacctgcaggtcagcaaatcgagaataaaccactgtggctgacgcccagtttcttcgtttatgtggctggctacctgacgtaatttttcttcattacggcccaacagaatcactgtcgcaccatagcgtgcatacgtcatcgcggcttcacgaccaataccatcactggctcccgtcaccaggataatgcgatcattgagtaaatcttgttttggctggtaatgcatggctactcctcaacgacgttgtctgtcgcgctgccagtgtactttatgactttggggctttatgcctgaaacagaagggcatttcaatcagcctggggcgataacaccgcaaaatggatactttgtcatactttcgctgcaataacatctctgcgagacggcttaacatgcctgttgtaaactgtgagccaaagcgttgtttaaccaaggtggggactcgtggaattgttgtctgaatatggtttgtttttggcgaaaatcgttaccgttgtgctagcgattgcggcgattgccgccattattgtcaatgttgctcaacgtaataaacgccagcgtggcgagttacgggtcaacaatctcagcgaacagtataaggagatgaaagaagaactggccgcggcgctgatggactcacatcagcaaaaacagtggcacaaagcgcagaagaaaaagcataagcaagaagcgaaagcagcaaaagcgaaagccaaactgggagaggtggcaactgacagtaaaccccgcgtctgggtgctggattttaaaggcagcatggacgcccatgaagtgaactcgctacgtgaagagataacggctgtactcgcagcattcaaaccgcaggatcaggttgtactacgtctggaaagccctggtggcatggtgcatggttacgggttggcggcttcgcagctgcagcgtctgcgtgataaaaacattcctttaactgttacggtagacaaagtcgctgccagcggcggttacatgatggcctgtgtggcggacaaaattgtttccgcaccgtttgctattgtgggttccattggggtggtggcgcaaatgcccaactttaaccgcttcctgaaaagcaaagatattgatatcgaacttcacaccgccgggcagtataagcgtacgctgaccttgctgggtgaaaataccgaagaagggcgggagaaattccgcgaagagctgaacgaaacgcatcagttatttaaagattttgtgaagcgtatgcgtccgtctctggatattgaacaggtggcaacgggtgaacactggtacggacaacaggcggtagagaaaggcctggttgatgaaatcaacaccagtgatgaagttattcttagcctgatggaaggccgtgaagtggtcaatgtacgctatatgcagcgtaaacgactcattgaccgactcaccggcagcgcggcagagagcgccgatcgattgttgttacgctggtggcagcgggggcaaaagccattgatgtaaaagacaaacgcgagggtaagacctcgcgttttgctttaatcaaccaggtgatatttttctgaaagcacatgggccaggtgtttgaacatattaaacaccgcggtgcttttggctgttggcaatccttgttcatctaaaaagtagtcgccggtaaataccagcacgccattacgctgcgtgacgccggtggcttcaatccctgcgagcgtatcctcatgctcacgaatgattttgttggcctctttcaacagcgtctcgcggtcgatgggttgtgtctctttgttcattatttactccttaaacaaggacattagtctacgccaggcatggcttgcagacaaatataccacgctggtggcaagagcgccttactggcaactttggattttgcatgctaataaagttgcgtatcggattttatcaggtacagtgtgacgctttcgtcaatctggcaatagatttgcttgacattcgaccaaaattccgtcgtgctatagcgcctgtaggccaagacctgttaactcagtcacctgaattttcgtgaacagagtcacgacaaggggttgatatccgcagagagcgagtccatatcggtaactcgttgccagtggaaggtttatcaacgtgcgacgcattcctggaagaatcaaattaggtaaggtgaatatgggtaaagctcttgtcatcgttgagtccccggcaaaagccaaaacgatcaacaagtatctgggtagtgactacgtggtgaaatccagcgtcggtcacatccgcgatttgccgaccagtggctcagctgccaaaaagagtgccgactctacctccaccaagacggctaaaaagcctaaaaaggatgaacgtggcgctctcgtcaaccgtatgggggttgacccgtggcacaattgggaggcgcactatgaagtgttgcctggtaaagagaaggtcgtctctgaactgaaacaactggctgaaaaagccgaccacatctatctcgcaaccgaccttgaccgcgaaggggaagccattgcatggcacctgcgggaagtgattgggggtgatgatgcgcgctatagccgagtggtgtttaacgaaattactaaaaacgcgatccgccaggcatttaacaaaccgggtgagctgaatattgatcgtgttaatgcccagcaggcgcgtcgctttatggaccgcgtggtggggtatatggtttcgccgctgctatggaaaaagatcgctcgtggtctgtctgccggtcgtgtgcagtcggtggcagtccgcctggtggtcgagcgtgagcgtgaaattaaagcgttcgtgccggaagagttctgggaagtcgatgccagcacgaccacgccatctggtgaagcgttggcgttgcaggtgactcatcagaacgacaaaccgttccgtccggtcaacaaagaacaaactcaggctgcggtaagtctgctggaaaaagcgcgctacagcgtgctggaacgtgaagacaaaccgacaaccagtaaacctggcgctccttttattacctctacgctgcaacaagctgccagcacccgtcttgggtttggcgtgaaaaaaaccatgatgatggcgcagcgtttgtatgaagcaggctatatcacttacatgcgtaccgactccactaacctgagtcaggacgcggtaaatatggttcgcggttatatcagcgataattttggtaagaaatatctgccggaaagtccgaatcagtacgccagcaaagaaaactcacaggaagcgcacgaagcgattcgtccttctgacgtcaatgtgatggcggaatcgctgaaggatatggaagcagatgcgcagaaactgtaccagttaatctggcgtcagttcgttgcctgccagatgaccccagcgaaatatgactccacgacgctgaccgttggtgcgggcgatttccgcctgaaagcacgcggtcgtattttgcgttttgatggctggacaaaagtgatgcctgcgttgcgtaaaggcgatgaagatcgcatcttaccagcagttaataaaggcgatgctctgacgctcgttgaactgacaccagcccagcactttaccaagccgccagcccgtttcagtgaagcatcgctggttaaagaactggaaaaacgtggtatcggtcgtccgtctacctatgcgtcgatcatttcgaccattcaggatcgtggctatgtgcgagtagaaaatcgtcgtttctatgcggaaaaaatgggcgaaatcgtcaccgatcgcctggaagagaatttccgcgagttaatgaactacgacttcaccgcgcagatggaaaacagccttgaccaggtggcaaatcacgaagcagagtggaaagctgtactggatcacttcttctcggatttcacccagcagttagataaagctgaaaaagatccggaagagggtggtatgcgcccgaaccagatggttctgaccagcattgactgcccgacttgtggtcgcaaaatggggattcgcacagcgagcaccggggtattccttggctgttctggctatgcgctgccgccgaaagagcgttgcaaaaccaccattaacctggtgccggaaaacgaagtgctgaacgtgctggaaggcgaagacgctgaaaccaacgcgctgcgcgcaaaacgtcgttgcccgaaatgcggcacggcgatggacagctatctcatcgatccgaaacgtaagttgcatgtctgtggtaataacccaacctgcgacggttacgagatcgaagagggcgaattccgcattaaaggttatgacggcccgatcgttgagtgtgaaaaatgtggctctgaaatgcacctgaaaatggggcgtttcggtaaatacatggcctgcaccaacgaagagtgtaaaaacacacgtaagattttacgtaacggcgaagtggcaccaccgaaagaagatccggtgccattacctgagctgccgtgcgaaaaatcagatgcttatttcgtgctgcgtgacggtgctgccggtgtgttcctggctgccaacactttcccgaaatcgcgtgaaacgcgtgcgccactggtggaagagctttatcgcttccgcgaccgtctgccggaaaaactgcgttatctggccgatgcgccacagcaggatccggaaggtaataagaccatggttcgctttagccgtaaaaccaaacagcaatatgtctcttcggaaaaagacggaaaggcgactggctggtcagcattttatgttgatggcaaatgggttgaaggaaaaaaataacctttaattctgtcaggtttttataaacaaagggtcgcgaaagcggcccttttttattgcatattattttttcttcacacctatacactaaggctataaatgatatagtggttatagttagcaccttttttattattaaatcgtattagtcacccgccaggtgtgacgaaaaaacgatgttctgatggcgtctaagtggatggtttaacatgaaattacaacaacttcgctatattgttgaggtggtcaatcataacctgaatgtctcatcaacagcggaaggactttacacatcacaacccgggatcagtaaacaagtcagaatgctggaagacgagctaggcattcaaattttttcccgaagcggcaagcacctgacgcaggtaacgccagcagggcaagaaataattcgtatcgctcgcgaagtcctgtcgaaagtcgatgccataaaatcggttgccggagagcacacctggccggataaaggttcactgtatatcgccaccacgcatacccaggcacgctacgcattaccaaacgtcatcaaaggctttattgagcgttatcctcgcgtttctttgcatatgcaccagggctcgccgacacaaattgctgatgccgtctctaaaggcaatgctgatttcgctatcgccacagaagcgctgcatctgtatgaagatttagtgatgttaccgtgctaccactggaatcgggctattgtagtcactccggatcacccgctggcaggcaaaaaagccattaccattgaagaactggcgcaatatccgttggtgacatataccttcggctttaccggacgttcagaactggatactgcctttaatcgcgcagggttaacgccgcgtatcgttttcacggcaacggatgctgacgtcattaaaacttacgtccggttagggctgggggtaggggtcattgccagcatggcggtggatccggtcgccgatcccgaccttgtgcgtgttgatgctcacgatatcttcagccacagtacaaccaaaattggttttcgccgtagtactttcttgcgcagttatatgtatgatttcattcagcgttttgcaccgcatttaacgcgtgatgtcgttgatgcggctgtcgcattgcgctctaatgaagaaattgaggtcatgtttaaagatataaaactgccggaaaaataatttcttgcgttattttcggcaccttttatgtagcgaaggtgccggaatatattctcttttgttacttatttctataccgtgcacaatatttttatccctcatatttatagggtaaattacctgtaaagtagtgtctaattacccgcctcgcaaactccagttttcaaatatctatttcaggtcaaaagattgaattattcactggagacgattcgtaaattcgctggatttttggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctatctctgctctcactgccgtaaaacatggcaactgcagttcacttacaccgcttctcaacccggtacgcaccagaaaatcattgatatggccatgaatggcgttggatgccgggcaactgcccgcattatgggcgttggcctcaacacgattttacgtcacttaaaaaactcaggccgcagtcggtaacctcgcgcatacagccgggcagtgacgtcatcgtctgcgcggaaatggacgaacagtggggctatgtcggggctaaatcgcgccagcgctggctgttttacgcgtatgacagtctccggaagacggttgttgcgcacgtattcggtgagcgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataagttggagtcattacctatgccagcatagtgacaatgaaacagaaacgaaacgggaatgttccgtcgttattccagacgactggcaactaacatcgcagcagcaagcctttatagaactgtttgctgaagatgatcagccgaaacaataattatcatcattcttattactcatttttaatgaattaaagggcttttaatacaccgcagcaataacagcttgagttatctcaacacaaaataataaccgttaagggtgtagcctatgatcaacacaaatatgaaatattggtcctggatgggcgcgttttctctgtcgatgctcttctgggccgaactcctctggatcattactcactgatccttgaccccgctgcggcggggttgtcatttgctttgccacaaggtttctcctcttttatcaatttgggttgttatcaaatcgttacgcgatgtttgtgttatctttaatattcaccctgaagagaatcagggcttcgcaaccctgtcattaaggaggagctatgtcgtcaaccctacgagaagccagtaaggacacgttgcaggccaaagataaaacttaccactactacagcctgccgcttgctgctaaatcactgggcgatatcacccgtctacccaagtcactcaaagttttgctcgaaaacctgctgcgctggcaggatggtaactcggttaccgaagaggatatccacgcgctggcaggatggctgaaaaatgcccatgctgaccgtgaaattgcctaccgcccggcaagggtgctgatgcaggactttaccggcgtacctgccgttgttgatctggcggcaatgcgcgaagcggttaaacgcctcggcggcgatactgcaaaggttaacccgctctcaccggtcgacctggtcattgaccactcggtgaccgtcgatcgttttggtgatgatgaggcatttgaagaaaacgtacgcctggaaatggagcgcaaccacgaacgttatgtgttcctgaaatggggaaagcaagcgttcagtcggtttagcgtcgtgccgccaggcacaggcatttgccatcaggttaacctcgaatatctcggcaaagcagtgtggagtgaattgcaggacggtgaatggattgcttatccggatacactcgttggtactgactcgcacaccaccatgatcaacggccttggcgtgctggggtggggcgttggtgggatcgaagcagaagccgcaatgttaggccagccggtttccatgcttatcccggatgtagtgggcttcaaacttaccggaaaattacgtgaaggtattaccgccacagacctggttctcactgttacccaaatgctgcgcaaacatggcgtggtggggaaattcgtcgaattttatggtgatggtctggattcactaccgttggcggatcgcgccaccattgccaatatgtcgccagaatatggtgccacctgtggcttcttcccaatcgatgctgtaaccctcgattacatgcgtttaagcgggcgcagcgaagatcaggtcgagttggtcgaaaaatatgccaaagcgcagggcatgtggcgtaacccgggcgatgaaccaatttttaccagtacgttagaactggatatgaatgacgttgaagcgagcctggcagggcctaaacgcccacaggatcgcgttgcactgcccgatgtaccaaaagcatttgccgccagtaacgaactggaagtgaatgccacgcataaagatcgccagccggtcgattatgttatgaacggacatcagtatcagttacctgatggcgctgtggtcattgctgcgataacctcgtgcaccaacacctctaacccaagtgtgctgatggccgcaggcttgctggcgaaaaaagccgtaactctgggcctcaagcggcaaccatgggtcaaagcgtcgctggcaccgggttcgaaagtcgtttctgattatctggcaaaagcgaaactgacaccgtatctcgacgaactggggtttaaccttgtgggatacggttgtaccacctgtattggtaactctgggccgctgcccgatcctatcgaaacggcaatcaaaaaaggcgatttaaccgtcggtgcggtgctgtccggcaaccgtaactttgaaggccgtatccatccgctggttaaaactaactggctggcctcgccgccgctggtggttgcctatgcgctggcgggaaatatgaatatcaacctggcttctgagcctatcggccatgatcgcaaaggcgatccggtttatctgaaagatatctggccatcggcacaagaaattgcccgtgcggtagaacaagtctccacagaaatgttccgcaaagagtacgcagaagtttttgaaggcacagcagagtggaagggaattaacgtcacacgatccgatacctacggttggcaggaggactcaacctatattcgcttatcgcctttctttgatgaaatgcaggcaacaccagcaccagtggaagatattcacggtgcgcggatcctcgcaatgctgggggattcagtcaccactgaccatatctctccggcgggcagtattaagcccgacagcccagcgggtcgatatctacaaggtcggggtgttgagcgaaaagactttaactcctacggttcgcggcgtggtaaccatgaagtgatgatgcgcggcaccttcgccaatattcgcatccgtaatgaaatggtgcctggcgttgaaggggggatgacgcggcatttacctgacagcgacgtagtctctatttatgatgctgcgatgcgctataagcaggagcaaacgccgctggcggtgattgccgggaaagagtatggatcaggctccagtcgtgactgggcggcaaaaggtccgcgtctgcttggtattcgtgtggtgattgccgaatcgtttgaacgaattcaccgttcgaatttaattggcatgggcatcctgccgctggaatttccgcaaggcgtaacgcgtaaaacgttagggctaaccggggaagagaagattgatattggcgatctgcaaaacctacaacccggcgcgacggttccggtgacgcttacgcgcgcggatggtagccaggaagtcgtaccctgccgttgtcgtatcgacaccgcgacggagttgacctactaccagaacgacggcattttgcattatgtcattcgtaatatgttgaagtaacaactatttgcttgccggttattttgcttccggcaagcaaatgaattacacaatgcaagagggttatttgttcagcaaatggcccattttctcggctttggtatcgagataatgttcgttattggggttacgacctacaatcaatggtacgcgttcaacaatattaatccctgcttcggtcagaatttcgacttttttcgggttattggttaacaagcggacttcattgacgccaaggagtttgaacatatcagcgcaaagagtgaagtcgcgctcatcagcggcgaagcctaactggtggttagcctctacggtatcgtaaccttgatcctgcagtgcgtaagcgcggattttattcagcagaccaatgttacgaccttcctgacggtgatacagcaaaataccacggccttcctcggcaatttgcgtcaatgccgcttcgagctggaagccacaatcgcagcgcaagctgaacagggcgtcaccggtcagacattcggaatggacgcgcgcaagtaccggggtatgcccggaaatatcgccatagactagcgcgacatgatcgtgtccggttgccagttcttcaaatcccaccatcaggaaatcgccccatggggttggcagtttggcttctgccacacgtttaagctgcatgaaattctccagataatgctggttctgtattggcttattttgccataacgagaaggggttcacctaatcacgacgcgtcgatcgttcacggaatggcacaaatctgtcaatttttcctggaactggcgttttcagttatgattgtgggacttatcaaaaaggagaggccatgcgttcgattgccagacgtaccgcagtgggagctgcactattgcttgtcatgccagtagccgtatggatttctggctggcgttggcaacctggagaacaaagttggctactaaaagcggctttttgggttactgaaactgtcacccagccctggggcgtcattacacatttgattttattcggctggtttctctggtgtctgcgttttcgcattaaggctgcctttgtattatttgccattctggcggccgcaatccttgtgggacaaggcgttaaatcctggatcaaagacaaagtccaggaaccacgaccttttgttatctggctggaaaaaacacatcatattccggttgatgagttctacactttaaagcgagcagaacgcggaaatctagtgaaagaacagttggctgaagagaaaaatatcccacaatatttgcgttcacactggcagaaagagacggggtttgcctttccttccggtcacacgatgtttgctgccagttgggcactgctggccgttggtttgctgtggccgcgtcggcgaacgttaaccattgctatcttgctggtctgggcaacgggagtcatgggaagccgcctgctgctcgggatgcattggccacgcgatctggtagtagctacgttgatttcgtgggcgctggtggcggtggcaacgtggcttgcgcaacgaatttgtgggccattaacaccacctgcggaagaaaatcgcgaaatagcgcaacgagaacaagaaagttaacgctggttgattttccgaatttagcccttaaatcatcaacaatgcgtgtggatgccatttcgcagacggcgcgaaaatggtactttaaagggctattgcggtaagttgaccataatttattcgctctaaccacataacgggaagtaatgtgaaatatttactcattttcttactggtgttagcgatcttcgtgatttcggtcacgttgggtgcgcagaacgatcaacaggtgacgtttaattatctgttagcgcaaggggagtaccgtatttccacattgctggcggtattgtttgctgcggggtttgctatcggttggttgatttgtggcctgttctggctgcgagttcgtgtttccctggcgcgcgctgaacgtaaaataaagcgactggaaaaccagctttcacccgcgactgacgtggctgtagtgccgcactcgtcagcggcgaaggaataactttctatgctggagttgttgtttctgcttttgcctgtagccgctgcctatggctggtatatgggccgcagaagtgcgcaacaaaacaagcaagatgaagccaaccgcttgtcgcgtgattacgtagcgggggttaacttcctgcttagtaatcaacaggataaagcggtagacctgtttctcgatatgcttaaagaggatacaggcaccgttgaagcccaccttacgctcggaaacctgttccgttcgcgtggcgaagttgatcgcgctattcgcatccatcagaccctaatggaaagcgcctcgctgacctatgaacagcgtctgttggcgattcaacaactggggcgtgattacatggccgccgggttatatgaccgcgcggaagacatgttcaatcagctgaccgatgaaactgacttccgcattggcgcgctgcaacagttgctacaaatctaccaggctaccagtgagtggcagaaagcaattgatgttgccgaacgcctggtgaagctgggtaaagataaacagcgcgtcgaaattgcccatttctactgtgagttagccctgcagcatatggccagcgacgatctcgatcgtgccatgaccttgctaaaaaaaggggcggcggcagataaaaacagcgcccgcgtatccataatgatgggacgcgtgtttatggcgaaaggagaatacgccaaagccgtcgaaagtctgcaacgcgtgatatcccaggacagagaactggtcagcgaaacgctggaaatgttgcaaacctgctatcagcagttgggtaaaactgccgaatgggcagaattcctgcagcgtgcggtggaagagaacaccggtgccgatgctgaattgatgcttgctgatatcatcgaagcgcgcgacggtagtgaggccgcacaggtctatattacgcgccagcttcagcgtcatccgaccatgcgtgtgttccataagttaatggattaccacttaaatgaagcggaagaagggcgtgccaaagagagcctgatggtgctgcgtgacatggttggcgaaaaggtacgtagtaagcctcgttatcgctgccagaaatgtggttttaccgcatacaccctctactggcattgtccgtcttgtcgggcctggtcaaccattaaaccgattcgcggtcttgatggcctgtaatttttaaaaaaatcctactttagttacaacatactagttattgatgttccattgtgctacggcaacgacggcgcagaaaaagcctgccaggggaaaaatcgcaactgttaattttttatttccacgggtagaatgctcgccgtttacctgtttcgcgccacttccggtgcccatcatcaagaaggtctggtcatgacgttaactgcttcatcttcttcccgcgctgttacgaattctcctgtggttgttgcccttgattatcataatcgtgatgacgcgctgtcctttgtcgacaagatcgacccacgcgattgtcgtctgaaggtcggcaaagagatgtttacattgtttgggccacagtttgtgcgcgaacttcaacagcgtggttttgatatctttcttgacctgaaattccacgatattcctaacactgcagcgcacgctgtcgctgctgcagctgacttaggcgtgtggatggtgaatgttcatgcctctggtggggcgcgtatgatgaccgcagcgcgtgaggcactggttccgtttggcaaagatgcaccgcttttgattgctgtgacagtgttgaccagcatggaagccagcgacctggtcgatcttggcatgacactgtcacctgcagattatgcagaacgtctggcggcactgacgcaaaaatgtggccttgatggtgtggtgtgttctgctcaggaagctgtgcgctttaaacaggtattcggtcaggagttcaaactggttacgccgggcattcgtccgcaggggagtgaagctggtgaccagcgccgcattatgacgccagaacaggcgttgtcggctggtgttgattatatggtgattggtcgcccggtaacgcaatcggtagatccagcgcagacgctgaaagcgatcaacgcctctttacagcggagtgcatgatgagtgattccaacagccgtctggtctactcaacggaaaccggacgtattgatgagcccaaagcggcccctgtacgccctaaaggcgacggtgtggtgcgtattcagcgtcagaccagtggacgtaaaggtaagggcgtttgcctgattaccggtgtcgatctcgatgatgccgaactgacaaaacttgcagcggaactgaagaaaaaatgcggctgcggcggagcagttaaagatggagttattgaaatccagggcgataagcgtgatttattaaaatcactacttgaagcgaaagggatgaaggtaaaactcgcaggcggttaacataaaaagccacggatatatccgtggctttcgaatattttactgtgtgtattattcagttatttcgtactgaacagaatcaagcgtattataattgcgagtcgataatcgacatttatttacgattatttaccgacctggtgaccaataacaccaccgacagctgcaccacctaatgtacccaacgtactgccatcggtcagtactgcaccgcctaatgcccctgcacccgcgccgattgcggtgttgcggtcccgtttagaccagttagaacaggcactcagagacattgccaaagtaattgccagaacagccgcggtcatttttttgctcgttacaaacataatactctctcctgaatttatgattcacggaagtaagctctctataactataatagctaagaataagcctggtgaaattattccgtgaaatctgctcgcgcgcagggttatatcacgcaggtgataatgacttcctgttatatcgctgataataattttatatcttgagagtgttaataacaggtaaatagtcttaattatcaaccaggaatcatcttagagcggatgatttgccaaactgcaaatcatccgtagagaagggaaatggttaaatgtcaacgacgtgaacggtgagtttactgtgctcaagatgcatcagatcgctggcgcgtattttcgaatcggtaatcacgcgattgaatcgctcaacgggaccgatggagtatgaatgtacagcaccaaatttcgagctgtcagtcaggactatcgcttcgcactctttttccagcacggcattgaccacatcggtacgcatcatatcgcgaccggtaaatccagtttcaggttgccagccatcaataccaataaatgctttgctgaaatgcacctgttggatgcactggcgtgtcaaagggccaaccatactttcgctttttttctgatacacgccaccgagcaaaataacttcacaaggcgcgtctttcagcaaatgcgcgatgtagctgctgaccgtgatgatagtgacatttttcttctgctcgcccagagtccgggcgagtagggcattgctgctgccattttcgataaagatggtttcgcccggttgaaccagcgacgcggcaaactcggcgagttcacgcttcagcgtatagttgctcatcatacgggtttcgacgtcatcactatcaagcgaaacagcaaagccatgtgcacggcggaggtaactcagtttttcgagtgtgttgagatcctggcgaatggtaacttcagaaactccagtggcttttgccagatcggttacgctaacctgaccctggtcaatgaccatctgtagaatagtttgttgtcgggaattcatcgctgtaattcttataacgttataatacttaataaaaaaatactgacgcgccgggcatcctcaaataggaaaacctgaaggcacgattgttaaatctcccacggtgccttcgggatgtctggcgtagattcagcaacctggcgcaagagttctgctttaagtatctcgagattatggatcgcagagtggtaatcgcctgccacaaggatatctaacacaatatcaatacgttcggcaacgcgctgggcatcaaattcagacatcaaggacatccttatagcaaaagtggaaaatgaataatgcaaaaattgccgctaaaagagaagtgtttaacagcaacggctaattatcatccaggaatacgatatataatgacgggatatagcgctaagtatatatattcatctacttatgcgcgcttcagatagcgtttataccagcgttcgaaggcgacggcgggcatcggtttggcaaacaaaaatccttgccgctcattgatcccgttcttggttaaaaaagcatcttcctttgcactctctacaccttcggcgatcacctgaagattcaatgcctgggccacagcgacgatcgcccggaccagtgactgcgagacaggttgtttgtgaatatctcgaacaaaaacctggtcaagtttgatggcatcgatcggaaagcgcgccagttgcgaaagtgaagagtagccggtaccaaaatcatccagatgtacttgcgcacctagttggctaaattgttgaataacagacagtgccagttcatcattctcaatcagacaactctctgtcagttcaacatctatagggcagtattcaaaattgagttcctggagaacctgtttcagggcggtgaaaatggtttgatcggcgagctgacgtgcagaaatatttaccgccactcgcaggtttatgcctttatcccgccactttgccacctggcgtacgacatcgagaatcacccaacggcctaaaggcacaattagccctgactcttcggcgtaggaaatgaagtccaacggtggaatcaacccacgttcaggtgactgccaacgtactagtgcttccagactgcgcacttcgccacgccaggtgattttcggttgatagtgaataaccaactgatcgttttctagtgctttacgcaagttggtatccagccagagatattcaaatacccgttgattcatttctggggtaaaaacgcaaaattgtcctcgtccgccttccttcgctgtgtacattgctgtgtcggcgtgacgaataatagccgcgctgtccgaaccatgttcgggagagagtgcaatacctactgaacagctggtataaacttcaattaaaccaatacgaaaggggaggcgtaagcgggtcaaaattcgtgatgccattgcttccagcgcgctttgtgaggtattggatgccagtaccagaaactcatcgccacctggacgcgccaacacctggtcatgttcgagacagcttaaaatagccaatgacacgtcgcgtaataactggtcaccaaacaaatgcccataggcgtcgttgacctttttaaaattatccaaatcaagatacacaaccccaactttattgttatctgcatgattaatagcgtgatcgattaactcctgcattgcgttacgattcggcagtccggtgatactgtcggtatttgccagaatacgcagtcgctcctgagcgcggcgctcttcggtaatgtcggtaccggaacagattaaaaaaatctcgtttttgccactgccgctgtggacaaatttattgcgaaacagaaacagccgctggcctttacgtgttggtatccacagttcgacttcatatgcattgccgcttcgaaaaaatacacggttattgcgcctggatgccgcagcttcacgacggctcataaacagtttaaacacgctttgcccaatgacgtcgtgttctttcaaccctgtgtaatcttcacataagcgattgaagcgttgaatattcccccggctgtcgagaatgactattgcggaatgtgcttcagaaactacctgctcagcaaaggaaagcccgtgtgataaatcacgagcaaccgccggtgtgtcatgccatgcagacgcgttgccagcccattcccgtttattgatttttcgtcctaccagatgcacagaaagatcgctttcatcgacggtcagactcatcatcaggctggaggtgatgaccgtcatttccctgattcgagcagcctgttcggcagataactgcaacatacgttcaggttctgtggtttcggtggtagaaaagcgcaaaacatcgctgctttccgtcaaccgccagtatgaattgtgcgatccgagaaagttgtacaacgttgtggactccctaacggttttcatgatgcatatcctccggttaacagcggagtccgcggttaaataaaaggaacaacatgacttacatgaaattaacggcggctaaacgcattgttttttttatatatttatttgtaatccagttttggaaaaacgccagttttcaaacgaaagtcagttaaaaaactgccgggatatgatgaaggtagagcggggaaataaacggcccattcataaggaatgggccgtgaaaggagattacgcgaccgggcgcgcaataatgctgcgggtttccatgcggacttcggcaatggtgacgtcaataacgtcagttactttataaaccgtttcacctttaatttgtacggtgccgttttcctggctgcaaaccatttcatcgcgcacagcgtgtaagaaaggtgcaggaataaaggcgatagcgccgttatcaaccaaacgaacacgcatgccgccacggctgatatcgacaatttccgccgcgaaacgggtgtcggtcccggctttgtctttcaggaagcgtgcgtataaccagtcaccaacatcacgttctgccatccgattgagacggcgacgctcggccatttggacagtgatctcatcctgtggacgcgtcgcagtttcgcctttgataaccgctttcagcagacggtggttgatcatgtcgccatatttacggatcggcgatgtccaggtggcgtatgcttccagaccgaggccaaagtgaggaccgggttcagtgctaatttcagcaaatgactggaagcgacgaatgcggctgtcgaggaaaccagttggttgcgcatccagttcacgacgcagtttgcagaaaccgtccagcgtgagcacttcttcggcatcgacatgcagaccgtgcgttttcagcaacgctgccagcgcgtcggcattcgccggatcaaagcccatatgcacgttatagatgccaaaaccgagcttatcgcgcagtacgcgggccgcacaaatgttagcggcaatcatcgcttcttcgacgatacggttggcaatgcgacgaggctcggcgacgatatccagcacttcacctttttcaccgagaataaagcggtaatccgggcgatctttaaacaccagtgcgtggttatgacgccactcgccgcggcgttggcaaatttgcgctaacaaacggacttgttcggcaattgcttcactttcaggcttccagtcaccggtattttccagccagtcagaaacctggtcatacaccagcttcgctttggattcgatggtggcggcaaagaattcgatattatcttcaatggtgccatcagcggagagcgtcatgcggcatgccagtaccgggcggacttcattggcgcgcagtgagcagagatcgtcagaaagctcgcgaggcagcatagggatgttgaagccaggcagatagttggtgaatgcgcgaattttcgcggctttgtccagcttactgccttcagcaatccacgcggttggatcggcaatcgccacaatcagctgaagtttgtcatccggcaacgccttagcgaaaagggcgtcatccatatcttctgtgctggcactgtcgatggtgacaaaatccagcgcggtcagatcttcacgaaccagaccttcatcgagcatttcggtagcgacgccgtctggtgcttctttttccagattatggcgtgcaagggtaacccaccacggtacaaagtgatcgtcaccaaaagtgatgtattgtgtcagttctgcatagaaagaacgatcgcctttcagcggatgacggcgcatttcggcaaccgcccagtcgccttctttaaactcgtggttcaggccacgggctgcgcggcaaggaatggcgtcttttaagagtggatgatcaggaacgatggccagacggtcatttttgccctgaaccttacccacgaaacgagtcaggaacggttcaaccagttcttctggctctgcggattcacgttctttttcactgtggatcaccgcgataattcggtcgccatgcatgacttttttcatctgcggcggcggaatgaaataacttttttgcgcgtcgacttccaggaagccaaagcctttttctgtggcttttaccaccccttcagcgcgtggcgtctgggaatgcagttgctgtttaagctgcgctagcagcgggttgtcctgaaacataattgtctattttggtggccattagagcggctgacagttttacgcgaatctgtctgacgcggcaaggttaatatgtctcacccaacgcgatttttaagcgatttatccagccacacagcccgctccataccagcagattaataatctgcgttgatgatttttcgtgttcgagtaaagggctgaactgggcggcgctaaagcgatcgggtgctcgggtcagccattgtatcgcctgaacggtagcgtgctcaacagaatgacggtcagcccattggttaatttcattttcgcccttgcgcagaagggtgttgatttttttatattcatttactgaatccatacaggcggcaaaacaagcagggctgccatttatccgtgcgcataacaacgccgcaagctgattatccggctgtgtattaacccgtgtgctgtttaacaacttttcaagaagggaaagtgaaatagggtggagagagagtgtttcagccagttggcaaagttctgcagttgaactttttgtgtaatcttcaggtagtttttccacctcatagctgcttcgccagcgtattgattcatcagtaaacagtgacgcgtcggcatagttttgtatctccagaccgggtaaccagcgtaccggatgtccaagataagcctgaaatgtcgcaatggtccgcgcctgaaagccaataaatccaatgatttggttaatgattacacagtcccaggcagtaagaccgacgtcattcagatgctggcgcgatcggttgtcgataatagaaggcgagctaaccagttggcgggcatattgcgtgatttgtgccaaccgatgattactttccctggaggaatcaggcccggggagcggcgtaagtcgcgccgaatagtagttacataaccgctggacgccgcaaacctgagcaaccgtcagggccgtagacaagcgttcataagcggtgaaagtctgtgaacgggtcacggtaagctggtcagggaacaattccactgcaagaacgcgcgcagggaccagccatgaaaggaagggggccagcgtttcttcatcaaggatcacgtcgagcagaaagggatcgctgacctttgcggcttccgggaccagaggcagaacgtcatactccgcagtactggattgcgtttcatgataccagtggcttttgccggtgatgtggcgttgttccatgggcgctccttggtcgtaaaggaaatcgttatcctgacgcaaggcgggaaggggagaaagacggatcggcgataacaaatatcagaaaggtataacagagataacgggcggcagaacgccgcccatctttaccaacagaacgattatttcagttcgagttcgttcattgcagcgatgctgaaaccgccgtcaacgtggactacttcaccggagataccggcagagagatcggagcacaggaatgccgcagagttacccacatcttcaatagtaacggtacggcgaatcggggtaacggcttcgcaatgagccagcattttgcggaagtctttgataccggaagccgccagagtacggatcggaccagcagagatggcgttaacacgcacaccttccggacccatcgcgttcgccatatagcgcacgttcgcttccagagacgcttttgccagacccataacgttgtagttcgggatagcgcgctcagcgccaaggtaggaaagggtcagcagggcagaacccggattcagcatggagcggcaagcttttgccattgcaacgaagctgtaggagctgatgtcgtgggcaattttgaagccttcacgggtaacggcgttaacatagtcaccatccagctgatcgccaggtgcaaaaccaatagagtgtacgaaaccgtcaaatttcggccaaactttccccagttcagcgaacatggtgtcgatgctggcatcttctgcaacatcgcactgcagaacgatgtcagaacccaattgagcggcaaattcttctacgcggcctttcagtttgtcgttctggtaggtgaatgccagttcagctccttcgcggtgcatcgcctgagcgataccgtaggcgatggatagtttgctggcaacaccggttaccagaatgcgcttaccggaaagaaaacccatagctttaatccttattgttgatgcttgttgtgcctgaaaatcaggcgattcgtcgttttagtaaacagtacgaacagataaacggttattataatcaacctggctgtgagtagctatagttgccaggtccgaccggagcaggctgcggcagggggggcgcttttcccctcaccctaaccctctccccagaggggcgaggggaccgtattgtgcaaatattgttaccccagcaacaaacaggctcatacagcccctaaccctttcatggcgatggctgggacggttcagaccttgccgaatattctccagcaccgtctcctcattacaatcaatctcgttattccagaaacgcagcacggtccagccctgcgactcaagccagctagtgcgcctggaatcataggcaactgctaaatcatgctgcccaccatccagctcaacgactacacgcgccgagcagcaagcaaaatcgagaatgtagctccccactggatgttgacggcgaaatttgaaatcactaaaacgtcggctgcgaagatatcgccagagctttcgttcctgcaaagtgagattgcgtcttaaatcacgcgcatttgatttaattttatctatcacctcattctgacaagatttaatcttttgtcagaatgaggtgaataatctggaaggaggattcagaaaattagcgatctttacgccacgcatccgccgtcaatgcctcgccaaaatgaccggcaatcagccgtttggtgagttcatgcagcggcgatgccagcacatccgcggtgctgcctcgctcgacaacctcgccctgatgcatcaccagcacctggtcgctaatgtgcttcatcattccgatatgctgggtaacataaatatacgaaatgccctgtttttcctgtaattccagcatcagattaatcaactgcgaacgcatcgacatatccagtgaagcgagggcttcatcggcaataatgacttttgggcgcaatatcagcgcgcgcgccagacccagacgctgtttttgcccgggtgccaacatatgcggatagtaactgacgtgatccggtagcagcccaaccatacgcatcgtttcaataatctgtttgcgacgctgttccggttccaggtcggtgttcagacgcaatggaaaatccagaatttgcgagatacgttgacggggattcaacgaggtcgaaggatcctgaaaaatcatgcgaatacgctgactgcggaaggaataatcgccaaaatgcagcggatgatcgtcaatcaataactcgccgctggtaggctctatcattcccgccagcatttttgccagcgtggatttacccgaaccattctcgccaataatcgccagtgtctggccttcacgtagcgtaaagctcaagggttttaccgcttctacggtctgacgacgaaaccagccggtccggtagcggaacgttttacttaaattacgcacttcaagcagcgtttcgatcatctcactctttctccatgttcagcgggaaatgacaggcatagagatgatttttcgcccccgtcaaacgtggcgtcacaatgcattctcgttgtgcatacgggcaacgtggccccagacgacaaccaatcggtaactgttccagcagtgggatagcgccgggtagcgtattgaggcgacttttatgcggcatcgcgctgccgaagtctggtatcgcgcggatcagcgcctgggtataaggatgatgtggcatcgtcaccaactccttactcggcgcggtttccactgtttgaccgcagtaaagcacgttaattttatccgcccattggctaagcatttgtaagtcatggctgataagcaaaatagtggtattgctgttttggttgagacgcgtcagcaggcgaaagatttgcgcctgggttgttggctccattgagttggtcggttcgtcagcaatcagcagacgcggttgattcgccagtgcaatggctatcatcactttctgacattcaccttcggtcaactcatagggaaaactgcgcatcgcatctttgtgatctttaatccccacgcggtgcagcagttcaatggcacggcgtttgcgccagccaaaacgctgccaccaacggcctttataggtccaggctgggatgttttgcatcaactggcgacccacacgttctgaagggtcaagacacgactgcggttcctggaaaatcatcgacacgttatggccaaccagtttgcgccgttcgcgtgcggagagacgcagcaaatcgatatcatcaaaacgcatacggtcagcagtaacacgccagttatctttattcaccccacaaatcgctttcgcaatcaaactcttgccggaaccggattcaccaacaagaccgcggatttcaccttcggttaaggtcatacttacccggtcgacggctttaacccactcatcaccggttttaaattcaatggtcaggttacgaatatcgagtaatggcattattccacccccgcaataatcgcacgacgaacgccatcgccaaggaggttaaccaacaacacgctaatcataattgccgcacctggcagcatgacagtccacggggcgacataaatcagttccagcgcatcaccgagcatcgctccccattcaggcgaggggagttgtgcgccgagatcgagaaagcccagcgcggcgatatcgagaattgccatcgacagtgcgcgggtgatctcggtgaccagcccggcggtgatgtttggcatcacagcaaaccagagaatattcagcgttgatgcgccatccagacgggcggcgataacgtactctttttccagttcgtcatgcaccatgctgtaaatcgaacgtaccatacgcggcagcaatgccagccagacagcaaacatagcgtgggacaaactcggtccggcaaacgctacaacgataattgccaacagcagcgaagggatcgccagtaaggtatccagaatatggttaagcaccgctgagcggaggccgtgtgtcgccccggcgaaggtgcccagtaccaggccacagatcgtcgcggcaagcgtcaccacaaatgcgccacccacggttggcgcagctccgctcagtaaacggcttaaaacatcgcgtccgaggtcgtcagtccccaggaagaaagaaacttcgccatagcgcgaccatgacggcggcaataattgataaccgagaaattgctggtcgatgccgtaaggcgcaaaccagccgccaaaaatacacagtacagccagccccgcgcagccgtacaggccgaccatcgcagaggcgtcactataaaatttgcgccaggcggtacgcagcgtgcccggcgggcgcttttcgctgtatacgctatcgtaaggcataccattccttatgtttcagagggttagccatggcacccaaaatatcagaaatcacgttaacaataatgaccagtgagccacacaccatcactccggcggaaatggctgcgtaatcctgctggcggatggcgttaattaaccagcgccctaaacccggccagctaaaaaccatttcggtgatcatcgccagcgtcagcatggtggaaaactgtaagcccaggcgaggaataaccggcggtaacgcgttatgcagaacgtggcgacgcaaaatagtaaagcgcgacaaaccgcgggtcgccgccgcttttacatagttctggtcatacacttcgatagtgctgatacgcatcaggcggatcacttcagttgttggcgcaaccgacagggtgatcacgggcaatatcatatggcggattgcgctcatgatcatttcatcccgccatggtgagtccgaaagccaggcatcaatcaacgcaaaaccggtaatcggtttcacttcgtagagcagatcgaaacgccctgaaacgggcaaccaacctagcgtgagtgaacaaaacagcgtcaacagaagcgccagccagaacaccgggattgaaaagcccagtaaggcgatggcgttgatcaagttatcctgccacttatggcgcgtaatcccggcaatcatccccacggggatgccaacaatcagcgcaaaaccgaaggcgaggatgcacagttccatcgtcgccgggaagacctcttttaactgttcggcaatcggttgaccgttaatgctggaaacaccaaaatcccagtggatcaggccgttaaaccagaacacccaggcattccacagtgacgcgccttgtaacggcgcatgaggggtgaaatagctcaagctgaagccaacgaaggtcagcaggaacaaggtgacaatcaataacaaaatgcggcgtaaggtgaagataatcatggttttttcacctcatcctgtttctcgcgatacaccccagcaaaggaggcgttaccaaacgggctaagtaccagacctttgatatcgtaccgataggcctgcaaacgcaatgacgacgccagcggcaaaatgggcaattcctgcgccagaatactctgcgcttcgtcataggcttcaatacgcgccgccagctgctgcgaggagagcgccttacgcaacacgctgtcgaatttcggatcgcaccagtgggcgaggttggtctgtgaatgaattgccgcgcagctcagtaaaggacggaagaaactgtccgggtcgttactgtccgtcgcccaaccggataacgtcagatcatggctcatatccatcaaccgcgcctcctgaaagcgaccttctaccggcacaatcaccacttttacgccaacctgcgccatatccgcctgaatcagttcggcagttttcagtggactggggttccacgcctgcgaacgtgtgggcacccacagtttcagcgttaaattttccagccccaacgacttcaactgttcgcgcgatttcgccggattgtattcagtaattttagcctcgttgtcataggcccacgaggcgcgcggtaaaatagaggccgccgtttcagccgtaccataatagatggattgcatcaggcgctggttattaatcgccagtgccagcgcatggcggacagcgggattatttagcggcggtttggcggtgttaaatgccagataggcgacgttcatcccaggacgcagcgttaaacgcaagcgcgggtcgtcacgcaaaatggatagctggctggcagcaggccaggccagaacgtcgcattccccggtcaggagtttcgacagacgtccggtgccgccggagcctaaatccaccactacctgcggcattaacggtttaccgcgccagaagtcatcatgacgttgtaggcgaataaattgcccggcgcggtattccgacaactgatacggaccggtgccgaccggttgacggtcgagttgctcctggcgatcttctttctctaacttccgggcatattctgccgacatgaccgaagcataatgggttgcgaggtgccacaaaaaagaagcatccggctgggcgagtcggaactcaacggtatgattatccagtttgcggacgcttttcacgttatcggcaaattgcaggctgtcgaagtaggggaagttgctgccgttgacgttatgccacgggttgttgcggtcaaaaattcgctggaaggtaaacaccacatcgtcggcattcattttacgagtgggagtaaaccagtcggttttttgaaacggaacatcgcgacgcaggtggaagcgataggtcgcgccgttgtcgagtacttcccagctttcggcaagttccggcatcaggcgataggtatagggatcgacatccagcagtcgatcataaaactgggcggcaagggtatcgacaattaacccactgctcgctttggatgggttaaaggtgttgacttgcccgctgacgcaatagacaaaaccgctgtcgcggatatcagcatgcgggggagattcaggcgcggcgattgcctgaccactcacaagtccagcaatcaccaaaagagacgataatacctggcgcataatattaagggattttatgtaaagaggctatcttactaatatttaatgacatttgccattaccgtttgtgttcaggggtcgtaatgagggccgtgtggttggtcgttgaacagatggcgtcgccatctgttcaacattcgtacccgtgatttctctataactataactcacagaacaacttagcgaggagcagagcggtacgatcgtgagaaacccattaaagcacgctgcaatgcgtgtcattttaaccggatgcagagtgaacgctttatccggacaacgatactgaccgatcgtctgcaattaaataattactcattaccccattgattcaaaaactctgcgatctcatcaatgcgtacgggattaatccccgcttcagcagccatttcatgttgggcttcttcgctgatctcttcattgttcatcaaacgggtgagcagtaactggaagtagtgggccagcggtgtgcgttcagcgtctgcgacaggctctgcgcattcggtcgcgtactcatcggcaatatcaaaatattttagcgggatatcgtggttcattatttgcccctggggttaatgcgctaagcataagggcggatgatagcactcgtgatccgggtcatacatctttttatagttaatggcgcggcgcattaccctcaggcaggataatgcggcgcgcatccgactattacgtttcgctcactggcgttctgtcaccttcgtacagcggcactttgcgatagcggcgaatcagataccacaaatatgcgccgcctaacgaagcccataccagacccagcgtcagcgaggtggcttcgaggttaatccacagcacgcccaccgtcagcgcgccaaccagcggcattaataaatagtggaagtgttccttccagcttttattcattcctttgcgccgccagaagtggttgaacaccgacaggttaacgaaggtaaacgctaccaacgcgccgaagttaattaacgctgtggcggtaactaaatcgaagaacagcgccgacatcgcgacaatcccgaccataatgacgttcagtgccggagtccgccatttcggatgcacatagccaaacacgcgctccggaaacacattgtcgcgccccatcacatacagcagacgtgacacgctggcatgtgaggccaggccagacgctaacgtgttcacaaacgtggtgcaaaggaaaatcgactggaacagcttaccgccgacgtagagtgcaatttcaggcagtgcggcgtccgggtctttaaagcggctgatatcggggaagaacagctgcataaagaacgacgccgcgataaagataacgccaccatagaccgccgtcaggaagatggctttcgggatcacgcgtgcggcgtctggtgtctcttccgaaagtgtggtcactgcatcgaaaccaaggaaagagaagcagacgatcgtcgccccggtaataatcggaatcagatgcgcgttctcgctgataaacggctgtaacgaccagaccgtgccaacgccttctcctttatgcagtccctgaaccaccaggaagataaacaccaccatgatggagatttgcaccaacacaaacagggtattgaagttagcgaccaggttgacgctcttcagattcgcggcggttaaaatggcgacgaaggttaccacccacacccacggcggcacttccgggaagagggcggagagatagattttcgccaacaaaacgttgatcatcggcaaaaagagataatccagcagtgatgaccagccgaccataaatccgacgtgcgggttaatcgacttttgcgcgtaggtataggccgaaccggcctccggaaactggcgaaccagtttgccgtagctgatagcggtaaacagcacgcccgccagcgccagcaaataggacgccggaacgtgaccgtcgctaatgcctgacacaatgccaaaagtatcgaacacagtcatcggcgtgagataggccagacccatcattaccacctgccacaatttcagtgattttcgcagacgggttttgccgggttgcgcagcaatattcagtggtgaattaatagccataattgctgcctcccctgcgtaataaggtttgcggtcgtgtcgacctgaaatcaaacctgtttagcaagggaagcaaagggggcggagtccagtcagtcgcaggaggggcgcatacgcagcctccctcgccatgcggggatttaatcatcggcatcatctcatttcctcgtcacagtcttaatcgttaacggaagcccgttgccgcctgcgctccataacgcgacatccggaaaatgtctcgattaccagcaaatgtcaggcctggctccgctcaggccgatgaaacaaccccgcaaggggtattacgcgtttttcaacatccactcaatttctgtttctgtgatgaggcgctcaaactgcaacagctcatcatttttacaggcgtgatagacatggcaaaaccgttcgcctaaatagcggcgcaggtgatcattctcgataaactcacccagggcatcgctctggcgaatcgggaagggtaagccatcctgttccagcccgttgccttcgacttcttcctgcaacggcagctcgttatcaagaccgtgcaaaataccggcaaaaatcgctgccatcaccagatatgggttggcatcggcacccgccacgcgatattccacgcggtgattatgacgatcgccgcatggaatacgcagggcgacggtgcggttgttatggccccacgacgcctgcgtcggtacatacatccccggctggaagcggcgatacgagttcacgtttggtgccagcaacgccattgatgacggcatcagatcgatcattccggcgagcatttttttcagcagcggcgaatcttcgccttccgcgtcagaaagcacgttctcgccatgattattttgcatactgatatggatatgcatcccgctgcccgcgtgctcttcatacggcttcgccataaaagtggcgtgcatcttatgcttttctgccatcagacgcaccaggcgttttagcgccagcgcatcatcgcaggcttccagcacgttatcggtatggtaaaggttgatttcaaactgacccggcgaggcttcggcgaccgcaccgtcggcgggaattaactgtaactgcgccagttcatcaatatcattgagcacgtcggcgaagtggttgaggttatcaacggagtaaacctggctttgtgtattgcggtcatcggtgccgggcgcgcagggcggttgcagatacccttcagcgtcgcgctgacgatccagtaaatagaactccagctctaccgctacaaccgggaacaatccgcgctggcgtagctgctgccacaggcggttaagaacgttccgcggctcaacgtcaaagggagcgccatcttcatcgaccatggtcaggagcatctgaccgataaactctggatcggcggcagaaggggttaaggaaccgagaacaggaacacaagtacgatccggctcgcccatttcctgacccagacccgcttcttctactacgttgcccagaatatccattgcaaacaccgaggccgggaaataacaccctttctccaacttcttcaggcttgcaacagggatacgttttccacggaagcaaccattcaaatcagtaagtaaaacatcaacatattgcgtattcgggtagcgctccaggtagcgtttcacttcctgcgtaaaggcgctaccccgcctctcttctgactgctgaacaaagttctctacttcaacgatattggtttccatgattcttcgcctttggtttgttttccgctcgttatcaaagcgtaaaatataatgaccaccattcgaatctgtatgcaaactaaatgtttgtcaaatgttaaattgagtttgcaaaaatgaaaacccactgctagattgaaaaaatattgaacataaaggtcatttaaagcgcagtaatggcgataatttagtccactttgtgagattgagcatggaaaatataatgaacaatccggttatcggtgtcgtaatgtgcaggaacaggcttaagggtcatgcgacccagactctgcaagaaaagtacctgaatgccatcatccacgcaggcggcttgccaattgcgctaccacatgcgctggcggaaccgtcgttacttgaacaacttttgccgaaactcgatggcatttatcttcctggtagtcccagcaatgtgcagccgcacctatatggtgaaaacggcgatgagcctgacgccgatcccgggcgtgatcttctgagcatggcgataattaatgccgcactcgaaaggcgcatccccattttcgccatctgccggggtttacaagaactggtggtggcaaccggtggttcgttgcatcgcaagctgtgcgaacagcctgaattgctggaacatcgggaagatcccgaactgccggtggaacagcaatatgcaccgtcgcatgaagttcaggttgaagaggggggattactgtctgcgttgttacctgaatgtagcaacttttgggtaaactctctacatggacaaggggcgaaggtcgttagcccacggttgcgtgttgaagctcgctcgccggatggcttagttgaggcggttagcgtcatcaatcatccttttgcgctgggcgtacagtggcacccggaatggaacagtagcgagtacgcgctttcgcgtatattgttcgagggctttatcaccgcttgtcagcaccatatcgctgaaaaacagcgactctgaccactacagtttaaggaaatgcaaatatgagtgatgagggactggcgccaggaaaacgcttgtcggaaatccgccagcagcaggggctttcacaacgtcgtgccgccgaactctccgggctgactcacagtgctatcagtacgatagaacaagataaagtcagccctgccatcagtacgctgcaaaagctgctgaaggtgtatggtctgtcactctcggaattcttttccgagccggaaaaacctgatgagccgcaggtcgtcattaatcaggacgacttaattgagatgggtagtcagggtgtgtcaatgaagctggttcataacggtaacccgaatcgcacgctggcgatgatctttgaaacgtaccagccgggcacaaccactggggaaagaattaagcatcagggtgaggaaataggcactgtactggaaggtgaaattgttctgacgattaatggtcaggattaccacctcgtcgcggggcaaagttatgccattaataccggcatcccgcacagtttcagtaatacgtcggcaggtatttgccgaattatcagcgcccatacgcccaccacgttttaatctttttgttctgtaagccgggtaagcgcaatgcgcccggcaatctatacacaaaatcattcaagttgcatcaaggcggcaagtgagcgaatcccgatgagcttactcaggtaagtgattcgggggagcgaacgcagccaaggcagaggcggcttgaaggatgaagtgtatataaagaatgtcgccagaaataaacgggcatacggcccggggatctctgcgccctgacgttcacaaactgcatatatctgatagacgtgaaacaggagtcataatgaattttcatcatctggcttactggcaggataaagcgttaagtctcgccattgaaaaccgcttatttattaacggtgaatatactgctgcggcggaaaatgaaacctttgaaaccgttgatccggtcacccaggcaccgctggcgaaaattgcccgcggcaagagcgtcgatatcgaccgtgcgatgagcgcagcacgcggtgtatttgaacgcggcgactggtcactctcttctccggctaaacgtaaagcggtactgaataaactcgccgatttaatggaagcccacgccgaagagctggcactgctggaaactctcgacaccggcaaaccgattcgtcacagtctgcgtgatgatattcccggcgcggcgcgcgccattcgctggtacgccgaagcgatcgacaaagtgtatggcgaagtggcgaccaccagtagccatgagctggcgatgatcgtgcgtgaaccggtcggcgtgattgccgccatcgtgccgtggaacttcccgctgttgctgacttgctggaaactcggcccggcgctggcggcgggaaacagcgtgattctaaaaccgtctgaaaaatcaccgctcagtgcgattcgtctcgcggggctggcgaaagaagcaggcttgccggatggtgtgttgaacgtggtgacgggttttggtcatgaagccgggcaggcgctgtcgcgtcataacgatatcgacgccattgcctttaccggttcaacccgtaccgggaaacagctgctgaaagatgcgggcgacagcaacatgaaacgcgtctggctggaagcgggcggcaaaagcgccaacatcgttttcgctgactgcccggatttgcaacaggcggcaagcgccaccgcagcaggcattttctacaaccagggacaggtgtgcatcgccggaacgcgcctgttgctggaagagagcatcgccgatgaattcttagccctgttaaaacagcaggcgcaaaactggcagccgggccatccacttgatcccgcaaccaccatgggcaccttaatcgactgcgcccacgccgactcggtccatagctttattcgggaaggcgaaagcaaagggcaactgttgttggatggccgtaacgccgggctggctgccgccatcggcccgaccatctttgtggatgtggacccgaatgcgtccttaagtcgcgaagagattttcggtccggtgctggtggtcacgcgtttcacatcagaagaacaggcgctacagcttgccaacgacagccagtacggccttggcgcggcggtatggacgcgcgacctctcccgcgcgcaccgcatgagccgacgcctgaaagccggttccgtcttcgtcaataactacaacgacggcgatatgaccgtgccgtttggcggctataagcagagcggcaacggtcgcgacaaatccctgcatgcccttgaaaaattcactgaactgaaaaccatctggataagcctggaggcctgaaatgaccgaacataccagcagttactacgccgccagtgcgaataaatatgcaccattcgacacactgaatgagtcaatcacctgcgacgtttgcgtggttggcggcggctataccgggctctcctccgcgctgcatctggcggaagcgggctttgacgtagtggttctcgaagcctcacgcatcggctttggcgcaagcgggcgcaatggcgggcaacttgtgaactcctacagccgcgacatcgacgtgatcgaaaaaagctacggcatggacaccgcccgtatgctcggcagcatgatgttcgagggtggcgagatcatccgcgaacgtatcaaacgctatcagattgactgcgactaccgccccggcggcctgtttgtggcgatgaatgataaacagctcgccacactcgaagagcagaaagagaactgggaacgctacggcaataaacagctggagctgctggacgctaacgccattcgccgtgaagtagccagcgatcgctacactggtgcgctgctggatcacagcggtgggcatattcacccgctaaacctcgccattggtgaagccgatgccatccgcctgaacggcgggcgcgtgtatgagctttctgcggtcacgcagatccagcacaccacgcccgccgtggtgcgtactgccaaaggtcaggtgacggcgaagtatgtgattgtcgccgggaatgcgtacctgggcgataaagtggagccggagctggcgaaacgcagcatgccatgcggtacgcaggtgatcaccaccgagcggctgtcggaagatttagcccgttcgctgatcccgaaaaactactgcgtggaagactgtaattatctgcttgattactaccgtcttaccgccgataaccgcctgctgtacggcggcggcgtagtgtatggcgcgcgcgacccggatgacgttgagcgtcttgtggtgccgaaactgctgaaaaccttcccgcagttgaagggcgtgaaaatcgactatcgctggacgggcaacttcctgctgaccctgtcgcgtatgccgcagtttggtcgcctcgataccaacatctattacatgcagggctacagcggccacggcgtcacctgtactcatctcgccggacgtttgattgccgaactgctgcgcggcgacgccgaacgtttcgatgccttcgccaatctgccgcattacccgttccccggcgggcgcacgctgcgcgtaccgtttaccgcgatgggcgcggcgtattacagcctgcgcgatcgtctgggcgtttaatttccgattaacagtgaagagtcaaaaggtgtgaaacatgagcaacaatgaattccatcagcgtcgtctttctgccaccccgcgcggggttggcgtgatgtgtaacttcttcgcccagtcggctgaaaacgctacgctgaaggatgttgagggcaacgagtacatcgatttcgccgcaggcattgcggtgctgaataccgggcatcgccaccctgatctggtcgcggcggtggagcagcaactgcaacagtttacccacaccgcgtatcagattgtgccgtatgaaagctacgtcaccctggcggagaaaatcaacgcccttgccccggtgagcgggcaggccaaaaccgcgttcttcactaccggcgcggaagcggtggaaaacgcggtgaaaatggctcgcgcccataccggacgacctggcgtgattgcgtttagcggtggcttccacggtcgtacatatatgaccatggcgctgaccggaaaagttgcgccgtacaaaatcggcttcggcccgttccctggttcggtgtatcacgtaccttatccgtcagatttacacggcatttcaacacaggactccctcgacgccatcgaacgcttgtttaaatcagacatcgaagcgaagcaggtcgcggccattattttcgaaccggtgcagggcgagggcggtttcaacgttgcgccaaaagagctggttgccgccattcgccgcctgtgcgacgagcacggtattgtgatgattgccgatgaagtgcaaagcggctttgcgcgtaccggtaaactgtttgccatggatcattacgccgataagccggacttaatgacgatggcgaaaagcctcgcgggcgggatgccgctttcgggcgtggtcggtaacgcgaatattatggacgcgcccgcgccgggcgggttgggtggcacctacgccgggaacccgctggcggtggctgccgcgcacgcggtgctcaatattatcgacaaagaatcactctgcaaacgcgcgaatcaactgggccagcgtctcaaaaacacgttgattgatgccaaagaaagcgttccggccattgctgcggtacgcggcctggggtcgatgattgcggcagagtttaacgatccgcaaacgggcgagccgtcagcggcgattgcacagaaaatccagcaacgcgcgctggcgcaggggctgctcctgctgacctgtggcgcatacggcaacgtgattcgcttcctgtatccgctgaccatcccggatgcgcaattcgatgcggcaatgaaaattttgcaggatgcgctgagcgattaatagcccaacgcaataatgtctgatgcgctgcgcttatcaggcctgcaaacgacgttgattatgtatgccggataaagcattcacgccgcatccggcaagttgtattgcccaacttcgctaaatctggtgctttttcaacaacgcgcggaactgatgataggttaaccccagtaattcagccgcgcgcttctggttatatttcccttgttgcaaactgagttgcagcaactctttttcctgctgcatctgaaactcacgtaaatccagcggcagtgttggaagcgaggtggtttctgaaacggcgatagcgtcttcaggcggacgccgtttaaagggatcaataatgatgtcatcaagcggataatcgctggtgccgtggcgatacactgaacgttccaccacgtttttcaattcacgaatatttcccggccaacgataattcagcaatgtttctctggcgcgctccgtaaaccccgggaacagaggcagcttgatttcccgacacatctggatggcaaagtgttctgccatcaacataatgtcgctttcgcgctcgcgcagtggtggcagttgtacaacatcaaaagccagtcggtcgagcaggtcagcgcgaaaagtgccttcattgaccatcgccgggagatcggcattcgtcgcgcataccaaccgcacattcacctgcaatggctggctgccgccaacgcgctccagttcaccgtactcaatcacgcgcaataatttctcctgcaccatcatcggtgccgtagcgagttcatcaagaaatagcgtaccgccgtcggcacgttcaaatctccctggatgacgtttttgcgcaccggtaaacgcccccgcttcgtgaccaaacagttcggaatccagcagattttcatttaacgccgcgcagttaagggaaataaacggcccttgccaacgggaggagagataatgcaggcggctggcaatcagctctttacctgttccgcgctcgccgatgatgagcaccggtttgtccagcggtgcgagatgcgaaacctgttccagcacttcgagaaagctgttcgcctcaccgagtaaattatctttgtattctgccatgatgaaattcgccacttgttagtgtaattcgctaactcatcctggcatgttgctgttgattcttcaatcagatctttataaatcaaaaagataaaaaattggcacgcaaattgtattaactgttcagcaggacaatcctgaacgcagaaatcaagaggacaacattatgggtattttttctcgctttgccgacatcgtgaatgccaacatcaacgctctgttagagaaagcggaagatccacagaaactggttcgtctgatgatccaggagatggaagatacattggttgaagtacgttctacttcggcgcgcgcgttggcagaaaagaaacagctgactcgccgtattgaacaagcgtcggcgcgtgaagttgaatggcaggaaaaagccgaactggcgctgctgaaagagagagaggatctggcgcgtgcggcgttaattgaaaaacagaaactgaccgatctgattaagagcctggaacatgaagtgacgctggtggacgatacgctggcacgcatgaagaaagagattggcgagctggaaaacaaattgagcgaaacacgcgctcgccagcaggcattgatgttacgccatcaggcggcaaattcgtcgcgcgatgtgcgtcgtcagttggacagtggcaaactggatgaagcaatggctcgtttcgaatctttcgaacgtcgtattgaccagatggaagcagaagcggaaagccacagcttcggtaaacaaaaatcgctggacgatcaatttgccgaactgaaagccgatgatgcaataagcgagcaactggcacaattaaaagccaaaatgaagcaagacaatcaataataacatccaggcggcgtccgaaagcgccgccgctcatcgtctaaggagtacttatgagcgcgctatttctggctattccattaaccatttttgtgctgtttgttttaccgatctggttatggctgcattacagcaatcgttctggtcgcagtgaattgtcgcaaagtgagcagcagcgattagcgcaactggctgatgaagcaaaacggatgcgcgaacgtattcaggcgctggaatctattcttgatgcagaacatccgaactggagggatcgctaatggcgggcattaatcttaataaaaaattatggcgtattccgcagcagggtatggtacgcggcgtctgcgccgggattgccaactattttgatgtaccggtaaaactggtgcgtatcctggtggtactgtcgattttcttcggtctggcgctgtttaccctggttgcttacatcattttgtcatttgcgcttgatccaatgccggacaacatggcctttggtgagcagctaccttccagcagcgaattgctggatgaagtcgaccgtgaactggcggcaagtgaaacgcgtttacgcgagatggaacgttatgtcacttccgatacattcacgttacgtagccgtttccgtcaactgtgaggaaagttatgaatactcgctggcaacaggccgggcaaaaggtaaagcctggtttcaaattagcaggcaagctggtacttcttaccgcactgcgctatggcccagcgggtgtggcgggctgggcgataaaatcagttgctcgccgaccgctgaaaatgttgctggctgtggcgctggaaccgctgttaagtcgggctgccaataaactggcgcagcgttataaaaggtgaggggagtttcgcaaaaattgttaaatctcaggcctataatggatggcaattttcatccatagaaggacgcttacatgtttaaaaaaggcttacttgctctggcactggtgttttcactgcccgttttcgccgctgaacactggatcgatgttcgtgttccagagcagtatcagcaagagcacgttcagggggccatcaatattcccctgaaggaagtgaaagagcgcattgccaccgccgttccggataaaaacgacaccgtgaaagtgtattgcaatgccggacgccagtccgggcaggcaaaagagatccttagcgagatgggatatacccacgttgagaacgccggtggcctgaaagacatcgcaatgccgaaggtcaaaggttaaaagaattcaccatgagcggcgcttatgcgccgttttttttctgtcacaccttatttacatccccatagattatttgcgtcagctcacaaatacgcttttcccctggtaaaaaatgatttcctgcgtgactaaaacccttgtgctcaattgacagtttattttctgcggagtagtctctcgtttcatgggaccgctaccacggaaaggcaacatgaaacagaaaattacggattacctggacgaaatctacggtggaacatttaccgcaactcatttacagaaacttgtaacgcgtcttgagagtgcgaaacgattaattacacagcgacgtaaaaaacactgggatgaaagtgatgtcgtgttaattacctatgccgatcaatttcacagcaatgatttaaaaccattacccacatttaatcagttttaccatcaatggctgcaaagcattttttcacatgttcatttgttgccgttttatccatggtcatctgatgatggcttttcggtaattgattatcatcaggtcgccagtgaagcgggggagtggcaggatattcagcaactcggtgaatgcagtcatttaatgtttgattttgtctgcaaccatatgtcggcaaaaagtgaatggtttaaaaactatttacaacagcatccaggttttgaagatttttttattgccgttgacccgcaaaccgatctcagcgccgtcactcgcccgcgtgcgttaccgttattaacgccattccagatgcgcgatcattcaacgcgccatttatggaccacctttagtgacgatcaaattgacctgaattaccgtagccctgaagtgttgctggcgatggtggatgttttactctgttaccttgcgaaaggtgctgagtatgtccgcctggatgccgttggctttatgtggaaagagccgggaacaagctgcatccatctggaaaaaacacatctgattatcaaactgttacggtcgattattgataacgttgcgccaggtacagtgatcattaccgagaccaatgttccgcataaagacaacattgcttactttggcgcaggcgatgacgaagcacatatggtgtaccagttctcgctgccgccactggtgctgcatgcggtgcaaaaacagaacgttgaggcgctttgtgcgtgggcgcaaaacctgacactaccttccagcaacaccacctggtttaacttcctcgcctctcacgatggcatcgggctaaacccgctacggggcttgttgcctgaaagcgaaatattagagctggtcgaggcgttacagcaggaaggtgcattagtaaactggaaaaataatcccgacggtacacgcagtccgtatgaaataaatgtgacctatatggatgcgttaagccgccgtgagagtagcgatgaagaacgttgcgccaggtttatccttgcccatgcgattttgttaagtctccccggtgtgccagcgatatatattcaaagtattcttggctcgcgtaatgattacgcaggtgtcgaaaaactcggatataaccgtgcgattaaccgtaaaaaatatcacagtaaagagataacccgagaactgaacgatgaagctacattaaggcatgcggtatatcatgagttgtcgcgtttaattacacttcgtcgcagccataacgagtttcatccggataataattttaccattgatacgattaatttatccgtaatgcgtattcaaagaagtaacgctgatggtaattgtctgactggattgtttaatgtcagtaaaaatattcagcatgtaaatattactaatctgcatggtcgggatctgattagtgaagttgatatattgggtaatgaaataacgctgcgcccctggcaggttatgtggattaaataaaaaggaacatctcatgattaaatcaaaaatcgtgctgttatcagcactggtttcatgcgccctgatttcaggctgtaaagaagaaaataaaacgaatgtatccatcgaatttatgcattcttcggtggagcaggagcgccaggccgttatcagtaaattgattgcccgttttgaaaaagaaaaccctggcatcaccgttaagcaagtgcccgtggaagaagatgcctataacactaaagtcattactctttcacgtagcggttcgctgccggaagtgatcgaaaccagccatgactacgccaaagtgatggacaaagagcagcttatcgatcgcaaagcggttgccacagtcatcagcaacgttggtgaaggcgcgttttacgatggcgtactgcgtattgtgcgtaccgaagatggtagcgcatggaccggtgttcctgtcagcgcctggattggcggtatctggtatcgcaaagatgtgctggcaaaagcggggcttgaggagccgaaaaactggcaacagctgctggacgttgcacagaaactgaatgacccggcgaataaaaaatacggcattgcgctgcctacagcagaaagcgtgttgacggaacaatccttctcccagtttgcgttatccaaccaggctaacgtctttaacgccgaaggcaaaatcacccttgatacaccagagatgatgcaggcactgacctattaccgcgaccttgctgccaacactatgccgggttctaacgacatcatggaagtgaaagacgcctttatgaacggcaccgcgccgatggcgatttactccacctatatccttccggctgtgattaaagaaggcgacccgaaaaacgtcggtttcgtggtgccaaccgagaaaaactctgcggtctacggcatgttgacctcgctgaccattaccgccgggcaaaagaccgaagagacggaagcagcagaaaaatttgtcacctttatggagcaggcagacaacattgccgactgggtgatgatgtcgccaggtgctgcgctgccggtgaataaagcggtggtgactaccgccacctggaaagacaacgacgttattaaggcgctgggtgaactaccgaatcagctaatcggtgaactgccaaatattcaggtttttggcgcagtaggggataaaaactttacccgcatgggtgatgtgacgggttctggcgtggtgagttcaatggtgcataacgtcaccgtgggtaaagccgatctctctactacgctgcaagcgagccagaaaaaactggatgaactgatcgaacagcactaaacccaggacaggaatccgcaatgaacaggcttttttcaggtcgttccgatatgccctttgcgctgctgcttctcgcgcccagcttattactgctgggcggtctggtggcgtggccgatggtgtcgaatatcgaaatcagttttttacgtctgccgctcaatcccaacatcgagtcaacgtttgttggggtgagcaactatgtgcgtatcctctccgatcccgacttctggcattcgctgtggatgacggtctggtataccgcgctggtggtggcgggcagcaccgtgctcgggctggcggtggcgatgtttttcaaccgcgagttccgcctgcgcaaaaccgcgcgttcgctggtgatcctctcctacgtaacgccgtccatttcgctggtgttcgcctggaaatacatgttcaacaacggctacggcattgttaactacctcggcgtcgatcttctgcatctctatgagcaggcaccgctgtggttcgataatccgggcagtagctttgtgctggtggtgctgttcgccatctggcgctacttcccgtatgcctttatctcgtttctggcgattttgcagaccatcgacaaatcgctgtacgaagcggcagagatggatggcgctaatgcctggcaacggtttcgtatcgtcacgctgcccgcaattatgccggtcctggcgacggtggtgacactgcgcaccatctggatgttctacatgttcgcggatgtttatttgctgacgaccaaggtcgatattctcggtgtatatctctacaaaaccgcctttgcctttaatgatttaggaaaagcggcggcgatctcggtggtgctcttcatcattattttcgctgtcattctgctgaccaggaaacgggtgaacctcaatggcaacaaataaacgcacactcagtcgcatcggtttttactgcgggctggcgctgtttctcatcatcacgctgtttccattttttgtgatgctgatgacctcgttcaagggcgcgaaagaggcgatctcactgcatcctacgctgctgccgcagcagtggacgctggagcattacgtcgacatttttaacccgatgattttcccgtttgtcgactacttccgtaacagtctggtggtgtctgtggtttcatccgtggtggcggtattcctcggcattcttggggcttacgcgctttcccgcctgcgctttaaaggtcggatgaccatcaacgccagcttttacacggtgtatatgttctctggcattttgctggtggtgccgcttttcaaaatcatcaccgcgcttggcatttacgacactgagatggcgctgatcatcaccatggtgacgcaaactctgcccaccgccgtgtttatgctgaaaagctacttcgacaccatccccgatgagatcgaagaagcggcgatgatggatggcctcaaccgtctgcaaattatcttccgcatcaccgtgccgttggcgatgtccgggctgatatccgtgttcgtctactgctttatggtggcgtggaacgactatctgtttgcgtcgattttcctctccagcgccagcaatttcaccttaccggtgggcctgaacgcgctgttcagtacgccagattacatctggggacggatgatggcggcctcactggtgaccgcattgccggtggtgattatgtatgcgctttcggaacgttttattaagagtggtttgaccgccggtggcgtgaagggctaaagcggccagtttctttacaaggagttttaaatgaaaaagttagtagccacagcaccgcgtgttgctgcgctggttgagtatgaagatcgggcgattttagctaatgaagtgaagatccgcgtgcgtttcggcgcaccgaaacacggaacggaagtggtcgacttccgcgccgccagcccgtttattgatgaagactttaacggcgaatggcagatgttcactccgcgtccggcagatgcgccgcgcggcattgagtttggcaaattccagcttggcaacatggtggttggcgacattatcgagtgcggcagcgacgttaccgactacgcggtgggcgacagcgtatgcggctacggcccgctctccgagacggtcatcattaacgcagtgaataactacaagctgcgcaaaatgccgcaaggcagctcctggaaaaacgccgtctgctacgacccggcgcagtttgccatgagcggcgtgcgcgatgccaacgtgcgcgtaggggattttgtggtggtggtagggcttggcgcaatcggtcaaattgccatccaactggctaaacgcgctggcgcttctgtggtgattggcgtcgatcctatcgcccatcgctgtgatattgcccgtcgccacggcgcggatttctgccttaaccccatcggcactgatgtaggtaaagagatcaaaacgctgaccggcaagcagggtgccgatgtgattatcgaaaccagcggctacgccgacgcgctgcaatcggcgctccgcggtctggcttatggcggcaccatctcctatgtcgcgtttgccaagccgtttgccgaaggttttaacctcggacgcgaagcgcatttcaataacgccaaaattgtcttctctcgcgcgtgcagcgaaccgaacccggattatccgcgctggagccgcaagcgtattgaagaaacctgttgggaactgctgatgaacggttatctcaattgcgaagatttaatcgacccggtggtgacctttgccaatagcccggaaagctatatgcagtatgtcgaccagcatccggaacagagcatcaaaatgggcgttacgttttaattcaaaggaatgaaaaaaatgaaaatcggcacacagaatcaggcgttctttccggaaaacattctggagaaatttcgttatatcaaagagatgggcttcgatggttttgagattgacggcaaactgctggttaacaacatcgaagaagtcaaagcggcgatcaaagaaaccggtttaccggtgaccaccgcctgcggtggctatgacggatggattggcgactttatcgaagagcgtcgtcttaatggcttaaagcagatcgagcgcattctcgaagcgctggcagaagtgggcggtaaaggcatcgtcgttccggctgcgtggggcatgtttaccttccgcttaccgccgatgacctcgccgcgtagcctggacggcgaccgcaaaatggtgagtgattccctgcgcgtactggaacaggtcgccgcgcgtaccggaaccgtggtgtatctcgaaccgttaaaccgctatcaggatcatatgatcaacaccctcgccgatgcccgccgttacatcgtcgaaaacgatcttaaacatgtacagattatcggcgatttctatcacatgaatatcgaagaagataacctggcgcaggcgctgcatgacaaccgcgacctgctcggtcatgtgcatattgcggataaccatcgctaccagccgggcagcggcaccctggatttccacgcgctgtttgaacagctgcgcgcggataactatcagggctatgtagtgtacgaagggcgtatccgggcggaagatcctgcccaggcgtaccgtgattcgttggcctggttgcgtacctgctaagaggtctttgtgaaaagtgcaatgacaagctctccgctgcgggtcgcgataataggcgcaggccaggtggcggataaggttcatgcttcgtactactgcacccgcaacgatctggaactggtggctgtctgtgacagccgcctttcccaggcgcaggcgctggcagaaaaatacgggaatgcatccgtgtgggacgatccgcaggccatgctgctggcggtgaaacctgatgtggttagcgtctgctcacctaaccgttttcattacgaacataccctgatggcactggaagcgggctgccatgtgatgtgcgaaaaaccgcccgccatgacgccagaacaggcgcgggaaatgtgcgataccgcgcgcaaactgggcaaggtgctggcctacgactttcaccatcgttttgcgctcgatacgcaacagctgcgtgaacaggtgaccaacggcgttttgggagagatttacgttaccaccgcccgcgccctgcgtcgctgcggcgttcccggctggggtgtctttaccaataaagaactgcagggtggtggcccgctgatcgacatcggcattcatatgctggatgctgcgatgtatgtgctgggctttccggcggtgaaaagcgtgaatgcgcatagctttcaaaagatcggcacgcaaaagagctgtggtcaatttggtgagtgggatccggcaacttacagcgtcgaagattcgctgtttggcaccattgaatttcataacggcggcattctgtggctggaaacgtcatttgcactcaacatccgcgaacagtcgattatgaacgtcagcttttgtggtgataaagctggtgcgacgctgtttccagcacatatctacaccgataacaacggtgaattaatgacgctgatgcaacgggaaatggcagacgacaaccgccatttgcgcagcatggaagcctttatcaatcacgtacagggcaagcccgtgatgatagccgacgccgagcaggggtacatcatccagcaactggtggcggcgttgtatcaatccgcagaaacagggacgcgtgtggaattatgaccaggccagtaacgttatcagaaccccatttcagccagcataccctgaacaagtatgcatcgctgatggcgcaggggaacggctatcttgggcttcgcgccagccatgaagaagattacacgcgccagacgcgagggatgtatctggcggggctgtatcatcgggcgggaaaaggtgaaatcaacgaactggtgaacctgcctgatgtcgtggggatggagattgccataaatggtgaggttttctcgttatcccacgaagcctggcagcgtgagcttgactttgccagtggcgaattacgccgcaatgttgtctggcgtaccagcaacggctcaggttacaccatcgccagccgtcgctttgtttcggcagaccaactaccgctcattgcgctggaaatcactattacgccactggacgccgacgcgtcagtgctgatttcaacaggcattgacgccacgcaaaccaatcacggtcgccaacatctcgacgaaacccaggtgcgggtgtttggtcagcatctgatgcaggggagctacaccacccaggatggacgcagtgatgtggccatcagctgttgctgtaaggtgagcggtgatgtgcagcaatgctataccgccaaagagcgccgtttactgcaacataccagtgcgcagcttcatgcaggcgagacaatgacgttgcaaaaactggtgtggatcgactggcgggatgacaggcaagctgctttagacgagtggggcagcgcgtcgcttcgccagcttgaaatgtgcgcgcagcagagttacgaccaacttcttgcagcatcaacagaaaactggcgtcaatggtggcagaaacgtcgtatcacggtaaatggcggcgaagcgcacgatcagcaagcgttagattatgcgctttatcatctgcgcatcatgacgcctgcccacgacgagcgcagcagcattgcggcaaaaggcttaaccggcgaaggctacaaaggccacgttttctgggatacagaagtatttttgttaccgtttcatctgtttagcgatccgacggttgcccgaagtttactgcgttatcgctggcacaacttgccaggcgcgcaggagaaagcgcgacgcaacggctggcagggcgcgctatttccgtgggaaagcgcgcgcagcggcgaagaagagacgccggaatttgccgccattaacattcgcaccgggctgcggcaaaaagtggcctcggcgcaggcggaacatcatctggtggccgatatcgcctgggcggttattcaatactggcagaccacgggggatgaaagtttcattgcgcatgaaggcatggcgctacttctggagacggcaaagttctggattagccgcgcggtgagagttaacgatcgtctggaaattcatgatgttattgggccagacgaatataccgaacatgtcaataataatgcatacaccagctatatggcccgctacaacgttcaacaggcgctgaatattgcccgccagttcggctgtagcgacgatgcgtttatccatcgcgccgaaatgttcctcaaagagctatggatgccagaaattcagcccgacggcgttttgccgcaggatgattcgtttatggctaagccggcgattaatctggcgaaatacaaagcggcggcggggaagcaaaccatactgctggattattcacgcgcagaagtgaacgagatgcagatcctcaaacaagctgatgtggtgatgctcaattacatgctgccggagcagttctcagcggcatcgtgtcttgccaatctgcaattttatgaaccgcgcactattcacgactcgtcattaagtaaagcaatccacggcattgttgccgcacgctgtggcctgctgacccaaagttatcagttctggcgcgaggggactgaaatcgatcttggtgctgatccgcatagttgtgatgatggtatccatgctgccgcaactggcgctatctggctgggggcgattcagggttttgccggggtgagcgtgcgtgacggtgaattgcatctcaatccggcgttacctgagcagtggcaacagttgtctttccctctgttctggcagggctgcgaattacaggtcactcttgacgcgcagcgtattgcgattcgaacttctgcgcccgtttcactgcgtttgaacggtcagcttataaccgtggctgaagaatctgttttctgtttgggtgattttattttgcccttcaatgggaccgctaccaaacatcagggggatgaatgaaactgcaaggggtaattttcgatctggatggtgtaatcaccgataccgcgcatctgcatttccaggcgtggcagcagattgccgctgaaattggcatcagcattgatgcgcagtttaacgaatccctaaaagggatcagccgcgatgagtctctgcggcgcattctgcaacacgggggcaaagagggcgactttaactcgcaggagagggcgcaactggcgtatcgcaaaaatctgctctatgtccactcactacgcgagttgacggtcaacgctgttctacccggcattcgctctttgctggcagatctccgtgcacagcagatctcggttgggctggcttctgtctccctgaatgcgccgacgattttagcggcgctggagctgcgcgagtttttcaccttctgcgcggatgcttcccaacttaaaaactcgaaaccggacccggaaatctttctcgccgcctgtgcagggctgggcgtgccgccgcaggcatgtatcggcattgaagatgcgcaggcgggcattgacgccattaacgccagcggtatgcgctcggtggggatcggcgcgggcttaaccggggcgcaattactgttgccttcaacggaatcactcacctggccgcggttatcggccttctggcaaaacgtatagcaaaggaatcaacatggctcagttttcgttacaacatattcaaaaaatctacgataaccaggtgcatgtggtgaaggacttcaacctggaaattgccgataaagagttcatcgtgtttgtcggcccgtcgggctgcggtaagtcgaccaccctgcgcatgattgccgggcttgaggagatcagcggcggcgatctgttgatcgacggcaaacgaatgaatgacgttccagccaaagcacgcaatatagcgatggtgttccagaactacgcgttgtatccgcatatgacggtttacgacaacatggcgtttgatctgaagatgcaaaaaatcgccaaagaggtgattgatgagcgggtgaactgggcggcgcaaattctcggcctgcgtgagtacctgaaacgtaagccgggggcgctttccggcgggcaacgtcagcgagtggcgcttgggcgggcgattgtacgcgaagcgggcgtgtttttaatggatgaaccgctctctaaccttgatgccaagctgcgcgtgcaaatgcgcgcagagatcagcaagctgcatcagaaactgaacaccaccatgatctacgtgacccacgatcagaccgaagcgatgaccatggcgacgcggattgtgattatgaaagacgggattgttcagcaagtaggtgcgccgaaaaccgtttataaccaacccgcgaatatgtttgtttccggatttattggatcaccagcgatgaattttattcgcggcacgatcgatggcgataaattcgttacggaaacgcttaaattaaccattcccgaagagaaattagcggttctgaaaacacaggaaagtttgcataagcccatcgtgatgggaatacgaccggaagatattcatccggacgcgcaagaggaaaataacatttccgccaaaattagcgtggcagaattaaccggtgcggaatttatgctctacaccacggttggggggcacgagttagtggtccgtgctggtgcgttaaatgattatcatgcaggagaaaatatcactattcattttgatatgacgaaatgtcatttctttgatgcagaaacggaaatagcaattcgctaaatacagggggaaggcattcccccaggataatacaaggaacaataatgaaaaagttattaccctgtaccgcactggtgatgtgtgcgggaatggcctgcgcacaggccgaggaaaggaacgactggcactttaatatcggcgcgatgtacgaaatagaaaacgtcgagggttatggcgaagatatggatgggctggcggagccttcagtctattttaatgccgccaacgggccgtggagaattgctctggcctattatcaggaagggccggtagattatagcgcgggtaaacgtggaacgtggtttgatcgcccggagctggaggtgcattatcagttcctcgaaaacgatgatttcagtttcggcctgcccggcggtttccgtaattatggttatcactacgttgatgaaccgggtaaagacacggcgaatatgcagcgctggaaaatcgcgccagactgggatgtgaaactgactgacgatttacgtttcaacggttggttgtcgatgtataaatttgccaacgatctgaacactaccggttacgctgatacccgtgtcgaaacggaaacaggtctgcaatataccttcaacgaaacggttgccttgcgagtgaactattatctcgagcgcggcttcaatatggacgacagccgcaataacggtgagttttccacgcaagaaattcgcgcctatttgccgctgacgctcggcaaccactcggtgacgccgtatacgcgcattgggctggatcgctggagtaactgggactggcaggatgatattgaacgtgaaggccatgattttaaccgtgtaggtttattttacggttatgatttccagaacggactttccgtttcgctggaatacgcgtttgagtggcaggatcacgacgaaggcgacagtgataaattccattatgcaggtgtcggcgtaaattactcgttctgataatgggctaaattgccggatgcggcgcgagtactttatccgatctataaatgtaggccggataagatgcgctagcatcgcatccggcattcaggcaaggtagctggtatttatttcagcgtcatatgcgtggcaacggtaatattctgtggtgacggttttccagaaattaagcggaataataactcgcagctttgttgacctaactcctgcgtcggaacatcgatgccgcccggtgcaggcgttaaaataaatgacagcgtttcattgctataacccaccaccgctaactgctgcggaatagcaatatttttctctgctgccgcacgataaatgctcattaatttcaggctgtcagtggcaaacaccgcctcaggcaacggtgactggcttaataattgccgtgctgcttttaatgcagtttcatgggtataaccgccatcaacaatccattcatcacgcactgcaatattatgcgcagccaggctctgcttataaccattaacgcgatcaaccgaaacatggacatcaagcggagcatgcaggcaggcaatattttgatgcccactttcaattaatgcatcggtcaacgcaatgctgtcgccaaaattatcggtatcgacagaataaacatgggcatattgaccttcaactttgccaatcaccaccaccggaatatcatatttatcgagttgggcaaaaaatgactcatccgctggcgaactgagcataataatgcctttaatcattttctgcttaattttgctttcgcatttttgcagatcttctgccggattgtgcgacgtttgtaatatcacgtcgaaaccttcttcttcagctttggcggtgatggcatgcaaaacttcagagaaaaacggattacccgccgtagttttggtcgaacgggtagaaatcaccataatggcatcaaaacccgaagaggtcagcgcgcgggccagcttgtttggctgatactgtaattcttcaatggcccgtaacactttttcgcgcgcttccggggagatattagtttgcttattcagcacgcgtgatacggtggattttgatacgcctgcaaccctggcaatatcataaatagtaggggacataggtcaggaactccgtccgaacgtgaatgctgcacatcttatggagttcgccggtcgatgacaacacgggcagttgataatcaatggcctggcccccacattcatatccttacgaatgattttttttctggtcttcagagcagcacaggacagcaatgaagcgacttaaaaatgaactcaatgcgctggtgaatcggggtgtcgacagacatctgcgcctcgctgtaaccggacttagccgcagcggcaaaacagcgtttatcaccgcgatggttaatcagttgcttaatattcacgccggagcacgtttgccgctgttaagtgcggtgcgtgaagagcgcctgctgggcgtgaaacgcattccccagcgtgactttggcattccgcgcttcacctatgacgaagggctggcgcagttatatggcgatccacccgcctggccaacgccaacgcgcggcgtcagtgaaatccgcctggcgctacgttttaaatcgaatgattcgctgctacgccactttaaggatacctccacgctgtatctggaaattgtggattatcccggcgaatggttgctcgacctgccgatgctggcgcaggactatttaagctggtcgcgccagatgacgggcttactcaatggtcagcgcggagaatggtcggcgaaatggcgaatgatgagcgaagggctggacccgctagcgcctgccgacgaaaaccggctggcggacattgccgccgcgtggaccgattatctccaccactgtaaagagcaggggctgcactttattcagcctgggcgctttgtcttgccgggagatatggcaggtgcgcccgcgctgcaattcttcccgtggccggatgtcgatacctggggcgagtccaaactggcgcaggccgataagcataccaatgccggaatgctgcgcgagcgctttaattattactgcgagaaggtggtgaaggggttctataagaatcattttctgcgctttgaccgccagattgtgctggtggattgcctgcaacctctcaacagtgggccacaggcatttaatgatatgcgtctggcactgacgcagctgatgcaaagttttcactacgggcagcgtaccctgttccggcgtttgttttcgccggttatcgataagctattgtttgctgccactaaagcggaccatgtgaccatcgatcagcacgctaatatggtttcattactgcaacaactgattcaggatgcctggcaaaatgcggcgttcgaagggatcagcatggactgcctggggctggcgtcagttcaggcgaccaccagcggcattattgatgttaacggtgagaaaatcccggcgctgcgtggtaatcgacttagcgatggcgcaccgctcactgtttatcctggcgaagttcccgcacgtttgcctggtcaggcgttctgggataagcaaggcttccagtttgaggcatttcgtccgcaggtgatggatgtcgacaaaccactaccgcatattcgtcttgatgctgcgctggaatttttaataggagataaattgcgatgaccgaaccgttaaaaccacgtattgatttcgacggtcctctggaggtcgatcagaatcctaaattcagggcgcagcagacctttgacgaaaatcaggcgcaaaattttgccccggccacgctcgacgaagcgcaggaagaagaggggcaagtcgaagcggtaatggacgcagcgttacgtccgaaacgcagcctgtggcgcaaaatggtgatgggcgggctggctctgtttggcgcaagcgttgtcgggcagggtgtacagtggacaatgaatgcctggcaaacccaggactgggtggcgctgggtggatgtgccgctggggcattgattatcggcgctggcgtaggttctgtggtaacagagtggcggcgcttatggcgcttgcgacagcgcgcccatgaacgcgacgaagcgcgtgatttattgcatagccacggcacgggcaaaggccgcgcattttgcgaaaaactggcgcagcaggcgggtattgatcagtcgcatccggcgctgcaacgctggtatgcctcaatccatgaaacgcaaaacgaccgtgaagtggtcagcctgtatgcgcatttggtccagccagttttagatgcccaggcgcggcgcgaaatcagccgttcggcggcggaatcaacgttgatgattgcggtcagcccgctggcgttggtcgatatggcgtttatcgcctggcgcaatctgcgtttaattaatcgcatcgccacgctgtatggcattgaactggggtattacagccgtttgcgtctgtttaagctggtattgctgaatatcgcttttgccggagccagcgaactggtgcgcgaagtggggatggactggatgtcgcaagatctcgctgctcgtttgtctacccgcgcagctcaggggattggtgcaggacttctgacggcacgactcgggattaaagctatggagctttgccgcccgctgccgtggattgacgatgacaaacctcgcctcggggatttccgtcgtcagcttatcggtcaggtgaaagaaacgctgcaaaaaggcaaaacgcccagcgaaaaataatgcaatatcgggtgctgaccggatatctttacgccgaagtgcccgtttttccgtctttgtgtcaatgattgttgacagaaaccttcctgctatccaaatagtgtcatatcatcatattaattgttcttttttcaggtgaaggttcccatgcgtctggaagtcttttgtgaagaccgactcggtctgacccgcgaattactcgatctactcgtgctaagaggcattgatttacgcggtattgagattgatcccattgggcgaatctacctcaattttgctgaactggagtttgagagtttcagcagtctgatggccgaaatacgccgtattgcgggtgttaccgatgtgcgtactgtcccgtggatgccttccgaacgtgagcatctggcgttgagcgcgttactggaggcgttgcctgaacctgtgctctctgtcgatatgaaaagcaaagtggatatggcgaacccggcgagctgtcagctttttgggcaaaaattggatcgcctgcgcaaccataccgccgcacaattgattaacggctttaattttttacgttggctggaaagcgaaccgcaagattcgcataacgagcatgtcgttattaatgggcagaatttcctgatggagattacgcctgtttatcttcaggatgaaaatgatcaacacgtcctgaccggtgcggtggtgatgttgcgatcaacgattcgtatgggccgccagttgcaaaatgtcgccgcccaggacgtcagcgccttcagtcaaattgtcgccgtcagcccgaaaatgaagcatgttgtcgaacaggcgcagaaactggcgatgctaagcgcgccgctgctgattacgggtgacacaggtacaggtaaagatctctttgcctacgcctgccatcaggcaagccccagagcgggcaaaccttacctggcgctgaactgtgcgtctataccggaagatgcggtcgagagtgaactgtttggtcatgctccggaagggaagaaaggattctttgagcaggcgaacggtggttcggtgctgttggatgaaataggggaaatgtcaccacggatgcaggcgaaattactgcgtttccttaatgatggcactttccgtcgggttggcgaagaccatgaggtgcatgtcgatgtgcgggtgatttgcgctacgcagaagaatctggtcgaactggtgcaaaaaggcatgttccgtgaagatctctattatcgtctgaacgtgttgacgctcaatctgccgccgctacgtgactgtccgcaggacatcatgccgttaactgagctgttcgtcgcccgctttgccgacgagcagggcgtgccgcgtccgaaactggccgctgacctgaatactgtacttacgcgttatgcgtggccgggaaatgtgcggcagttaaagaacgctatctatcgcgcactgacacaactggacggttatgagctgcgtccacaggatattttgttgccggattatgacgccgcaacggtagccgtgggcgaagatgcgatggaaggttcgctggacgaaatcaccagccgttttgaacgctcggtattaacccagctttatcgcaattatcccagcacgcgcaaactggcaaaacgtctcggcgtttcacataccgcgattgccaataagttgcgggaatatggtctgagtcagaagaagaacgaagagtaagcgcgaatatgcctgatggtgcaacaccatcaggcatattaaattatgctttcagtacagccagagctgcttcgtaatccggctcggtggtgatttcatccaccagctggctgaaaatcacattgtcattttcgtcaataaccacaacggcacgcgctgccagacctttcagtgggccatcagcaattgccacaccgtaggcttgcagaaattcagcgttacggaaagtggagagggtgataacgttgttcagaccttctgcgccgcagaaacgagactgggcgaacggcagatcggcagagatacacagcacaacggtgttgtcgatctcggttgccagttggttaaacttacgtactgatgcggcgcaaacaccggtatcaatactcgggaaaatgttcagcactttgcgtttacccgcaaactgaccgagggtgacgtcagacagatcttttgccacgagagtaaaagtctgcgctttgctacccgcctgcgggatggaattggcgactgtaaccgggttgccctggaaatgaacggtttgtgacatgattatctttcctgtttacatatagttaacgtcacacctagtttatgctaactgtcaataacacagcaaacgctatttgcgcttcatccgcagaccaccgcgacaacaaggagtaaagatgagaaccgttaaggtattcgaggaagcctggcccttacataccccgtttgtgattgcccggggaagtcgcagtgaagcgcgcgtggtggtggttgaactggaagaagagggtattaaaggcaccggcgaatgcacgccgtatccgcgttatggggaaagtgatgcctcggtaatggcgcaaattatgagcgtcgtgccgcaactagagaaagggctgacacgggaggagttgcaaaaaattctccctgccggcgcagcacgtaatgcgctggattgtgcattgtgggatctggccgcgcgaagacagcagcaatcgctggctgatttgatcggcataacgcttcccgagacagttatcactgcacagacggttgtcatcggtacgcctgatcagatggccaatagtgcatcaacactctggcaggcaggcgcgaaattactgaaagtgaagctggataaccatcttatcagtgagcggatggtggcaattcgcacagctgtgcccgatgcgacgctgatcgttgatgcaaatgaatcctggcgtgcagaagggttggcggcgcgttgccagctattggcggatttaggcgttgcgatgcttgaacaaccgcttcctgcgcaggacgatgcggcgctggagaattttattcatccgttgccgatttgtgctgatgaaagttgtcatactcgtagcaatttgaaggcgctgaaagggcgctatgagatggttaatattaagctcgataaaaccgggggtctgacggaagcgctggcgctggcgactgaagcgcgtgcacaaggtttcagtctgatgctgggctgcatgttgtgtacctctcgtgccattagcgccgctttaccgctggtgccgcaggtcagtttcgccgatcttgacggaccgacctggctggcggtagatgtggaaccggcgcttcagttcacgacgggcgaattgcatctttaggatgccagcgcagcaagtttgccatcgcaaagagatatttttcgctggcttcgtcggaggagatgggcggaaactctgcggtgatgcaatgcaagttcagatctgcacaccaactgccgaaagagccaggcgtttcataaccgacgctggttaccagaggcaattcaaacgcctgagccagccattcgcctaattcgctgtgtctgggatcttcaatacaggccagtggatcgtggaatgagaccacccaggcaggttgaatgcggtgtataagctggcacagcgcctgggtttcaggttcggagccaggtttgtcacctgtcagtaatacgacatcgcgttcttcagcggcgctgttccagcgataaacggtttcaccttccttccagttcgccgccggaaagtttctgtttaaatccacaccattagcattggcccgtaaccccaactggcagccgtcaggattcacacacagcaccacatgatgacggcgcaaagaaggtgtcaacgtccgcagagcacaggagagcgtgacgaccgaagagttttcatcaccgtgagtgccagccagaatcaaaccactttcgcggctggctgcaggggcaggaaaccagattaacggcgcgcccaataatgaacgtccgtaatgttctgttccgggcggaaatgcgccgcgttcggcgcgtgggcgggttacggtcatgatcgtctctggttcaggaagtattacaggcagtgttgtgcaaattttgcggattatcaaatccttttcttcaacgctatgtcatcgatcttgtatcacttttttgccggaagttgtttgcattttattagttggatagggtttgtggatttttgctggctgacgggcaaataaagtttgtttaatggtttgcttatctgccagttgattaatcacatggcgggctatctgaccgccagcaccaagaatcagtacatttttcatgaaaattatcccagattattggcagcaatatgccaggccatatcactattgcggatttgaatatgtttcattacagagtttcctcaaagaacggagctaatactgaaattgcttcagccacataggctttgccgtcataaagatccatatggtttgcgccttcaacaatgtgatagcgtttatcctggcttgatgctcgatcgtacaggtcgtcactcatccatttgctccctgcctggctgcccgccacaatctgcgtcggctgagtcaggtacacttccgccatatggtaagcatcataggtaataatctggttaaggctgcgcaaagtagcgtaacccggtgctgttggatactgcgcgcgaggggtgtggtaatactcccaggcctgacgcagttcttcgttcggcgcatcggactccttcattggtgccagtggcataatggcgtattctccgctgctaatatcgctggttctggcgtttgaacccgcttcaacgtatggcagggcatcaatagatttcacattgttttcccaaccattacggaatatcgaaccaatattgaccgcactaacggtaccgatggccttgatgcggcgatcctgaattgcagcattggctgtatatcctgcaccggcacaaattcccatcgcaccaattcgggtattgtcgacataagaaagcgttgtcaggtaatcaatcacggcactgatgtcttcagtacgaatgtatgggttttctaactgacgcggctcgccgccactttcaccttgataagatgcgtcataagcaatagtgacaaatcccttttccgccagttttttggcataggttccggccgtttgttctttaacgcccccacctgggtgagataacacaattgcctgatactgacgggtttcatcaaattttggagggaaatagatcactgcagacaaagagatggttggattattgctgttagtgaagctgactttattattcatcattccgttcctcatggagttgtcggttcgttttaacggttggtgatatcactatagatattgatcattaagttgattagacccaaaatcatgattagacctatcatttaaatgattaatagattgcatggagatactgaatgaagcgtgaagaaatcgctgatctgatggcgtttgtcgtcgttgcagaggagcgtagcttcactcgtgcagcagcccgcctgagcatggcgcagtcagctttaagccagatagtgcgtcgtatagaagaacgattgggattgcggcttctgacgcgaaccacgcgcagcgttgttccaactgaagcgggcgagcatcttttgtctgttcttggccctatgttgcatgacatagattcagccatggcatccctgagcgatctgcagaaccgcccatccgggacaatacgtattactactgtagaacatgcagcaaaaacgatattgttaccagcaatgcgcacattcctgaaatcgcatcctgaaattgatattcagctcaccattgattatggtttgaccgatgtcgtttctgaacgttttgatgcaggcgtccgtctgggtggggagatggataaagatatgatcgccattcgaatcgggccagatataccaatggctattgttggctcaccggattatttttctcgccgaagtgttccaacgtcagtgtcacaattaatagatcatcaggcaattaatttgtatcttcccacatcgggtacagcaaatcgctggagattaatacgcggtggacgtgaagttcgtgttcgcatggaaggtcagcttttactgaatacgatagacctgatcattgatgctgcaattgatgggcatggattggcgtatctaccttatgatcaggttgagcgggctattaaagaaaaaaaactgatacgtgttttggataaattcacaccagatttacccggttatcacctgtactatccacaccgtcgacatgctggctcggcattctcattatttatagataggctgaagtataaaggtgctgtttagcactacttgctgatacattaatttaattcttctcttaacgtattctcagttcctttcaacgttttggtcattttttattcttcgtacaatggcgacagatgctgattatgataccgaaaacgggtttgaacgtgcgaagcccgaacgtagtgttcggagttctatgtgctttaccgcattttggagactattatttacactaaatctgatttgatatattgatacttaaaacatttgatgcttcctttgtcacttttttgatggaagttgtttgcatttctttaaggcgaaacaaataattacgcatcaattttaatgtcggttagagggaaacttatgaagcactctgtttcagtcacgtgttgtgcgctgttggtcagcagcatttctctttcgtatgctgcagaagttccgagcggcacagtactggcagagaagcaggagctggtgcgccacattaaagatgagcctgcgtcgctggatcccgctaaagccgtgggcctgccagagattcaggtcattcgcgatctgtttgaaggtctggtgaatcagaacgaaaaaggggagattgtccccggcgttgcgactcagtggaaaagtaatgacaaccgtatctggacttttaccctgcgcgataacgcaaaatgggcggatggcacaccggtaacggcgcaagattttgtctacagctggcaacgtctggtggacccaaaaacattgtcgccatttgcatggtttgccgcgctggcgggaatcaacaacgcacaggcgattattgatggtaaagctacgcctgaccagcttggcgtcaccgcagttgatgcccatactttgaaaattcagcttgataaaccgttgccgtggtttgtgaatttaaccgctaactttgccttcttcccggtgcaaaaagccaacgtagaaagcggtaaagagtggacgaaacccggaaatctgatcggcaatggcgcttatgttcttaaagagcgcgtagtcaatgaaaaactggtcgtggtaccgaatacccattattgggataacgccaaaacggtactgcaaaaagtgaccttcctgccaattaatcaggaatccgcagccactaagcgttacctcgcgggggatattgatatcaccgaatccttcccgaaaaatatgtatcagaagctgttgaaggatattccggggcaggtttatacgccgccgcagctcgggacctattattatgcgtttaacacgcaaaaagggccgacggcagatcagcgcgttcgtctggcattaagtatgacgatagatcgccgcctgatgaccgaaaaagtattagggacgggcgaaaagccagcgtggcattttacaccagatgttaccgcgggatttacgccggaaccttcgccgtttgaacaaatgagtcaggaagaactgaatgcgcaggcaaaaactttgttgagcgcagctggttatggtccgcaaaaaccgctgaagctgacgcttttgtataacacttcagaaaaccatcaaaaaattgcgattgctgtagcatcgatgtggaaaaagaaccttggcgtagatgtaaaattgcaaaatcaggaatggaaaacctatatcgatagccgtaacaccggcaattttgatgttatccgcgcctcgtgggtgggggattataatgaaccctccactttcctgacattattaacgtcaacgcattcaggaaatatttcacgctttaacaatccggcatatgacaaagttctggcccaggcatcgacggaaaataccgttaaagcgcgtaatgccgattacaacgcggcagaaaaaatcctcatggagcaagcaccgattgcaccaatttatcaatataccaatggacgattaatcaagccgtggctgaaaggttatcccattaataatcctgaagatgtggcgtacagtcggactatgtatattgtgaagcattgatgtgatgggaactggcgttacccttgtgcataacgccagtgatgtctgatttagcgaccctgttccggcggtgtaatgttatccatatacagcgtctggctggggaaggcaaagtccgcgccgtgtgactgtacaatatcgataatcttcaaataaacgtcttgctgtgcagcaagccattcagcccataccgtggttttggtaaagcaataaaccataatattcaatgaagagtcagcaaactggttgaaataaaccagtaaggtttgtcgctggtcgatggccgggtgatttttcagcatctcacgtacagcttcgacaataacgcccacttttgccgcatcctcataacgtaaaccaatggtcgtggtaatgcggcggttggtcattcgtcctgggttttctacgctgatcgacgaaaacagcgagttcggtacgtacaatggacgattatcaaaggtcgtaattttggtaattcgccagccaatttccgctactgtaccttcgatatttctgtccggtgaacggatccagtcgccaatactgaaaggacggtcgaaatagagcataatcccggaaaagaagttactcagaatatctttaccggccataccgacagccagaccaccaataccaccaaaggtcagcaagccagaaaggctcatgccgaaatgttcgccataaagcagaacaagcaccacaataatggtgattttgatgatacgcgacataatccgcgcactggtgatatcgcgaccttttttaatctgctgtttttcaaactgattaatcagcagaaatagcttaatcgtcagaataaccgcaatcagggacgtacagataaaatcgataacgcctggggtgataaatttgagtttatagttttctataacataattaataatgctaccaacagcactgataattatggtgtagattaaaaattgcaccgcatggaataaaaatccttttcttttacgatttccacggcgaaaccaaaagctcatcagaatcaatgctgcgcagctaccgaaaataatgaccagattaagcgcattatttgtaaacagttcagcgatcattgttttatcaggctcctccagataattgtcgtcatgccggaaacccctggcggggctattttaccgcgacaattcattcagatcatcaatagtcagggaaggaagtagcaacattagctaactaatcaatgcgttgattgtaaatccagctaagaggtgaggttttcagagcagacaacggtgaaatgtcatggtattgttacgtttaggtaacaagaaatttgtctgcacaaggattacatcatgattatggcgaaactgaagtcagcgaaagggaagaaatttctctttggtttgttggcggttttcattattgcggcgtcggttgtgactcgcgcgaccatcggcggcgttatagaacagtacaatattccgctgtctgagtggacgacatcaatgtatgtgattcagtcatcgatgatttttgtttatagcctggtctttactgtgttgctggcaatcccgttgggaatttatttccttggcggcgaagagcagtaagtaaaaaataggcccgataactcgggccttgtcagttattgaagagtcgttaatcgtcttcttcgtcatccagttcaacgggtgtctgatactggtcaggtttaatgaccagcaggtcgcagcgaagatgatcaatcacctgttccgccgtgttgccgaggaatgctgctgaaataccggtgcgtccgaccgtgcccagaaccacaattcccgcctgtaaatgctccgccaaatcaggaatcacctcttcaggcagacctttttctacgtgcgtcatgttttcattaatgccgaatttctgccgcagagctttcattgccagcaaatgttgcccacgaatggcatcgttataaacgctcgggtcaaattccggcagttcaatcgcgatattaattggcgttaccggataagcgccaaccagatgaacttcggtatggttgacttgttctgccagttcgatcgtctctttgaccagtttttcattgagcgcattatgatacggctcttcactggcgagattcaccgccaccagcgccttgcctccttccggccacggctggtctttcaccatccacaccgggcttgggcatttgcgtaacagatgccagtccgttggcgtaaaaatcaccgcttccagacggtcatgttggtgcgccatttttagcaccaaatcgtgtccgccgctgatcacttcctgaataatggcttcgaaaggacggttatgccagaccactttaatttcaatgggaacgccagcattgagataatattttgcctgctcgtggatccaggctgtacgctggctgatgacgccctgacgcatagcggtacgttcgtccggggagagcagggtggtcatttcgtatgagaagtcatagatcggcaaaaaggctttaattttgccaccaatccgttgatgtaaataaacagctcgccgcaatgctggttggtcgtcctggttaggatcgataacaacgagcatgttctgatacatagccatacagggtctccttacaacaactgtcaacgcagtttgtaattaaaagattaacccatatctggtgaatgaaacagtgatgaaccttctgccagatcaataaatcagaaaaatttaatgatatgacagaaggatagtgagttatgcggaaaaatcaggcaacgttacgcgtatgaccagcaagctgggccagcgcatcgttattttcgatggtgatgtatttacctttgactgccagcataccgcttttctggaagcgacccagcagacggctgatggtttctaccgtcaggcccagatagttaccgatatcgccacgagtcatcgtcaggcggaattcacgaggggagaagccgcgttgggcaaaacgacgggacaggttgtagatgaatgcagccagacgttcctcggcatttttcttcgacaacagcaggatcatgtcctgatcgcctttgatttcaccgctcatcagacgcatcatctgctgacgcagattcggcattttaccggacaaatcgtccagcgtttcgaacgggatttcacataccatcgaggtttccagcgcctgagcgaagctcgggtgatggccgctgccaatagcatcaaatcccaccaggtcacctgctaaatgaaaaccagtgatttgctcgtcgccttgctcagtgatggtataacttttaatcgtaccggagcggatggcataaagcgatttaagttcatcaccagccttaaacagcgtctggcctttctgaataggcttcttccgctcaatgatattatcaagctgatcaagctcatgttcgttgagtgtgaacgggatgcaaagctggctgatgctgcaatcctggcaatggatagcacaaccgccagactgaatgcgccgtataattcgcttttccgggatcataggtctgctcaagccgtaattgatatttgtcaattttaacatctttttagggagcaagtaagtctaagcaaaccttaacagcagagaattccgatattagatgtaaatatatgtctatctatttgaaaaccattaagttgttaagggtaactttacataaaagtgtgaacaagctggcacaaattgtttaatgtttacagcaaaagataaccttcatggcgcaataaccactcttttcgctgaactccgcctgcatatccggtcatggtgccgtttcggccaataacccgatggcaaggtacgacgatgctgatgggattcgatccgtttgccgcaccaacggcacgcgccgcgccagggcggcccaattgttcagccagttggccgtaatgcattacctgcccgcaggggatagtgcgtagtgttttccagacttcgcgctgaaatggcgtcccccctgtggcagtgggaagcgtatcaataatgctaagattaccggcaaaataatcacgaagcttgtcgcttaaaccgcctgggttggtggcagaaatgcgctcatagccttctttgcgataatggatgtccagcagctgcaccatgcgttcgctgtactcttcccattcaaccgcccgcagacgaaattgttcatcgcaaatcacccacagtggacccagtggcgtggcaattttttcttcaagtaatctcagcatccgttctctcttaagacaaacgtggggaaatccccggacctatcggcagaccaacaagataccacgccagcaacatcagcagccataccaccaaaaagataagcggatagggcaagactaacgaatagtaagtacccagtttcgcgtctggtttgtagcgttgcaggaatccaagaaacagtggaacaaaaggagataccggcgctaaaggcaatacggatgagtcggcaatacgaaagaggatttgcgcaaatgccgggtgaaagccaagtagcataaacattggtacgaaaatgggggcaagaatcgaccagattgcggaaccgctggcaataaacatgcataagaaagaggaaagcaacgccagaccgacaaacgccgggatgccgctaagccctgaactttccagtatatcggtcagccccacggcgatgaatttccccatgttgctccagttaaacatggcgacaaattgggcgaggggaaaaaccatcacgataaatcccgccatctctttcatcggttcaatcattaaatgcggtaaatccgcctgacgtcgaattgtgcgggtagcgatgccataagccagcgagacaacaaagaaaaaaagaatgatcagtggcacgatacctttaataaagggtgatggcatcacggtgtgattaatcggatcgcgcaatatcccgttttgcgggatcaccatcagcgcaatcgcagcaataaaaagtagcgatacgacacctgctatgcgtaaaccaaaacgctgactttcggtcaatgtctgcagtttctcatcgctgtttccctgccattgacctaaccgtggctcgatgattttgtcggttatcaggccgccaacaatcgtcagtacgactacggagctggccataaaataccagttatcaattacactgacgtgcatttgcggattgaacgcagctgccgcttccgtgctgatccccgacagcaacacgtcggttgtgacaatcagtaaattagccgtaaagccgcaacctacgcctgcaatggcagccagtaaacctgcaactggatgcctgcccaccgccagaaaaatcagcgcacccatcggtggcatgatcactaacgccgcatcggaagaaatgtggctgaaaaaagcaataaacagcaccatataactggcgtagcgggcattaacatgcgatgccattttaaccattagtgctggcagtaagccgacgcgctccgccagaccggcacctaaaaccagcgccaggatcgcaccaagtggagcaaaaccgctaaagtttttaataacattgggtaaaaaccagtgtaatccttccacactgagcaggtttttcaccaccaccggcgtaccatcggtcgggtttttcgcactgacgccaaaggccgacaaaattgccgtcgtcaccatgagtacgataatcaaatagataaagagcagaaaaggatggggaaccttgttaccaattctttcgacccagccatagagcttcccggattgggaggacgacggtatggatgacatactcatgggcattcctcggttgttgtgtttgcgttgttgttgttattttaaaggtgacggtgtcacgtttttcgggatagggcagtgatacggttgcgtgtccgttacttgctgatgctcttgttggcattcttgcaatagccctgaatcaaggaagagattgactgtggttgctgccatagttttcgccgccagcagcattcctttatgagcaatagatgttcgcccctggctaaccagttgccacgtatgtagcggtgtaccgacggcaaaacaggggctgaaacactgggcaacaggcagtttccaactgacgtcgccgacatcagtcgatgccgcaagcacgttatcggtggcggcatatggagcgacttcattcgccagtaccgtttcacgatgacgtagtgcaaaaaccttgccgttttcgccaccggttgcggcgatattattcagactgttttgccgatcgttggaggtgagcgtagcctgaatttgtttcgcaaaagccagttcttcggagttccattccggggtaccaaaatgggatagggcctggtacatggcattttctaaggtgcgattcgggagataactggaacaggctttgtcgaagcggcattcaaccgtggtttcggtcatcaatgccgcaccttcggcgattttggcgacccgatcataaatatgctgcacgtcggtcatttcgggggcgcggataagataaagcacttctgcctgcgcctggaccacgttgggcgagatcccgccgctatttgtgatggcatagtgtacgcgcgctttttcaataatatgttcgttgaggaagttggtgccagtggtcatcaacgttacggcatcaagggcgctgcgtcccaaatgaggggaattcgcggcatgtgctgcgatccctttaaagcgccatgatgcctgaatgtttgccagcgtgcgggtattgaacataccggcaaaggcttccgggtgccaggtgagtgccgcatccacatcatcaaataccccctcgcgaaccatgaacgttttacccgagccgccttcttcgccaggacaaccataaaagcgcaccgtgccgccttgcccatattgttccagccatttcttgacggctattgcagcggcaaaggcggcggttcccagcaaattgtgtccgcaaccgtgaccattttcaccgggcgtcacggatgtaggttgcgcgcaacctgcttgctgacttaaacctgccagggcgtcatattctcccagcagggcgataaccggtttgccttgaccaaacgaagcaataaaggcatttgggatattgcctacgttgcgggtaacggtgaagcctgcagattccagcgccgaagccagatgctccgctgaccagaactcttcaaaacgtgtttctggatgatcccagatttgatcggcaatatcggtataacgttggcgatcggcttcaatcgcatcgtcgataaaacgatagatttcctgcatcagatacctcgcgtccagggaaaattgagcgcggtgcgcgccagcgtttcgacggcaatagcgagaacctgctcgtcaaaatcgaatttttcgttgtgatgacctgccgccagctgtgtgccaaacaccacgtaggaggcttgcccttgatgttgctgcacgcgggccatcattaatgtggcatcttcggaacccgcaggcgcttcaacacgttcaatggcctgattgacccccgcgacctgagccgcctgactttgcaaccatgcgacccattgcggcgaaggagaactggcggtagctgcacccatcagacgagtttcaacgccgacaccatacatggttgctgcgccctgaatcgcttgttgtgcacggtcaaaaacatattgattaatgacgtcgctggccccgcgtgtttccactttcagcaacgccgaggcaggaacaacgttacgaccgcttcctgcctgcataacgcccacgtttactctggaagctccttcgctgtgcggggcgattgcatgcagtgcaagagtggcttgtgctgccgccaacaaggcattgtgaccgtcttctggttttgcgcctgcgtgagcggcggtaccggtgaagtgcgcgtcaaatttggtggttgccataaaattatcactgccgcacaccacggtgcccgcaggtacgccagtgccaatgtgcacggcagtaaaataatcaacatcatctacgacacctgcatcgaccatcgcccgcgcgccacgcgtaccttcctctgcaggctgaaaaatcagtttgatgacgccatgtagtccggactcgaattgtttaagggtatgcgccagcccaagcccaatggcggtatgtccatcatgaccacaggcatgcatcattccggcgttacatgacgcaaaaccgtcgcggtaggggcgatggctgacatcctgctcttcactgagatccagcgcgtccatatcgacacggaaagccatcaccggaccggggcgaccggtatccagggtggcgacgatacccgtgaaaccaccttcaaaaaccgcaatccattgtgctagcgcaccctgttgacgagcgcgctcgaattcgcgttgtagagtgagttcatcaggtagtcccatccggctactttcattaactacttcgcggcccagcgccagtgaatagccgagctgctgcaattcttccgcaacaagggtggcagtgcggaattccacccagccagactctgcatagtgatgaaaatcacgtcgccagtgcgataattttggggcaagcgaattaacaaattgattcaaagactccataacctttcccgtcatcagtaaaaagtgtgacccggttcacgtagcgatagtttttacttatcactaactgatttttcacagttttaaccgttcataaattaccctgacacaatcatctgcattaaagtagatgccagtttctttggtctgataaataacggttatcggtggcgtcatggcttttcaggtaaaaattcatcaaattcgggcttttgttgaagtggctcgtcagggcagcattcgcggagcgagccgaatgttgaatatgtcgcaaccggcactgagtaaatctattcaggagctggaagaagggttagcggcgcaactcttttttcgccgtagtaaaggcgtgacgttaactgatgccggtgaaagtttttatcagcacgccagtcttattcttgaagagctgcgcgcagcccaagaggatattcgccaacgacaagggcaactggcagggcagattaatatcggcatgggggccagtatttcccgcagtctgatgccagctgtcatatctcgttttcatcagcagcatccgcaggtaaaagtacgcattatggaagggcaactggtgtcgatgattaatgaattgcgtcagggagaattggatttcaccatcaatacctattatcagggaccgtacgaccacgaatttacttttgagaaattactggaaaagcaattcgcgatcttttgccacccgggacaccccgccattggtgcccgttcgatcaaacagttactggattacagctggacaatgccgacgccacacggcagttactacaaacagttgagtgaattgcttgacgatcaggcgcaaacgccacaggtcggtgtagtctgcgagacgttctcagcctgtatcagtctggtggcaaaaagcgattttctcagcatactgcctgaagaaatgggctgcgatcccttgcacggacaggggctggtgatgttgccggttagcgaaattttaccgaaagcggcctattatttgattcagcggcgtgatagtcgccagacaccactgaccgcgtcattaatcacgcaattccggcgagaatgcggctatctgcaaagttaaaactgcataaaaaaatagagtctgtcgacatccgccagactctacagtacacacagcagtgcatccgcgtcttaaatccggcattgtctcctctgcgccggtgactgtgttataacggttttaacctttagttgccaattttcttcagtgacagatttcacgaaaatataagttacattattaatatcgtgaatgaataatcatgcataagtattttgcttaaaatatcggcaatatttggaacttattactggaaatttgggtaatacgttgttggaccgacccggtctggttatcatatcgcgctcttaattgcgggaggatgtaacatgaaccttgacgacaaatcgctgtttcttgacgccatggaagatgtccagccgctgaaacgtgctaccgatgtccactggcatccaacgcgtaaccaacgtgcgccgcagcgtatcgacacgctgcagcttgataatttcctcaccaccggatttctcgacatcatcccactaagtcagccgctggagtttcggcgggaagggttgcaacatggggtgctggataagctgcgcagtggtaaatatccgcaacaggcgagcctgaatcttttgcgccagccggtggaagagtgccgcaaaatggtgttcagttttattcaacaagccctggcggatggtttgcgtaacgtgctgattattcatggtaaagggcgggatgataaatcgcatgccaatattgtccgcagctatgtggcgcgctggctgaccgaatttgatgatgttcaggcatattgcaccgcgctaccgcatcatggcagcagcggggcgtgttacgtcgcactacgtaaaacggcgcaggcgaagcaagaaaactgggagcgccacgctaagcgcagtcgttgatctcgagacgcatccgcggcttatgccgccagcacgcggttgcgtccatcatttttcgcccgatacaaagcatcatcaacgcgtttaaacagttcatcgatgctttcatttccttcgtgatgcgccacaccaatgctgacggtaaagcgtggtaagcccgaaatactcacttttgccacgcttacgcggatagtttcagccagcgaaagcgcggtatccagtggggttcttggtagcaataagacaaactcttcgcctccccaacgaaacaccaaatcgcctttgcgagcgcaactttcgagggtgcgggcgagggcgcataacacctcatcacctttagaatgcccatagagatcgttaatgtgtttaaaacgatcggtgtcgatgagcaacaagctgtaatcctgagcgatggcgagatgctgcatttggcctggttccgtaatgtgataaaactgtcgccgattcagtaatccggtcatcgcgtcatggtgagcagcatgttccagctgctcctccagccgtttttgctcagtaatatcatgcacaatacataacatgagcttgtcgccataaatttcaatcggtccggcataggtctgcacatgacgagtcgaaccatccgccagtttatgaacaaaattcaaaggcttatgaccaccgggtaaatgcgagatttcatgcatgataggcatgacgcgacgcccgagcatatttatttcccaggtatgtttctggcacatcgtttcatggttataaccatagaaattgagcgcggcgaggttagcatcgacgatttgtccatctcgtgacgggtcaatcaacaacattggtgcagagttagtcagaaaaaagcgcgcataaaaaccttgttttttgcgctgataatttgccgagcgactggcttttaaacccagcgttgccggcgcttcgataccttcgaaaataatcaccggttctgtttctgtcagctttcgcaaaacaagccgacagctcaatgctgtttcctcttctttacgctgaacagtgaggatttcgataatatcgtgttggttttgcagatcggagaggtatttcggcagttctttttgtgaggagacggaatagggtccggttcgtagctgactaaacgtgaggtcttgcatcaacagtttcgccgcgctattggcataaattaactgttcctcaaagggcgaaacgatccagacaggactggtgagtaagtccagggtattgaagttgtgcgtaatcattgagatcccgttatttttatcaatttttgttgctatccgatcgcaaaaaagccacgtcatatgatcagataattctgataatgatagacgctatttaacacttcacacggtttgtatacggaaaagcattttgctttttgtattcaatttagacagaattttattaatcatttcagggtaatggggtgatgagatgttgcgtaacagggccagaaggctagactacaaaataatgcgttgatgatggaggcactgtggaagcgattaagggatcggacgttaatgtcccggatgcagtatttgcctggatgctggatggtagaggcggcgttaaaccgctggaaaatacagatgtgattgatgaagcgcatccctgttggctccaccttaattatgtacaccatgatagcgcccaatggctggcgacaacaccgctgcttcccaataacgtacgtgatgcgctggcgggcgagagcacgcgtccccgagtcagccgtctcggtgaaggcacgctgattacattgcgctgtataaacggcagcaccgatgaacgccccgatcaactggtcgccatgcgtgtatatatggacgggcggttaattgtttcgacccgacaacgcaaagtgctggcgctggacgatgtggtgagcgatctggaagagggcacgggtccgaccgattgcgggggatggctggtggatgtgtgcgatgcgttgaccgatcattccagtgaatttatcgagcagctgcacgataaaattatcgaccttgaagataatctccttgatcagcaaattccaccgcgtggattcctggctctgctgcgcaaacaattaattgtgatgcgtcgctatatggcaccgcaacgtgatgtttatgctcgtcttgccagtgaacgtttgccgtggatgagcgatgaccaacgccgtcggatgcaggatattgccgatcgccttgggcgcggccttgacgaaatcgacgcctgtatagcacggactggcgtgatggcggatgaaatcgctcaggtgatgcaggaaaatttagctcgtcgtacctatacaatgtcgttgatggcaatggtctttttacccagtacctttctgaccgggttatttggcgtcaaccttggtgggatccctggcggcgggtggcaattcggattttcaattttttgtattctgttagttgttcttattggtggtgttgctttatggttgcatcgtagtaaatggttgtaacaaaagcaatttttccggctgtctgtatacaaaaacgccgcaaagtttgagcgaagtcaataaactctctacccattcagggcaatatctctcttgcaggtgaatgcaacgtcaagcgatgggcgttgcgctccatattgtcttacttccttttttgaattactgcatagcacaattgattcgtacgacgccgactttgatgagtcggcttttttttgcctgttatttatcagcgtctaccctttaagagtccacccaatgaccagagggaaatatgacgacacttatttatttgcaaattcctgtccctgaaccgattcctggcgatcctgttccagtgcccgatccgatccctcgcccgcaacccatgcctgacccaccacccgatgaagaaccgattaaattgtcgcatcgtgagcgtagatctgcgaggatacgcgcctgctaactttgcgtcgatgaccacgagaatagattgtgaccgctttttctaccctgaatgttttgcctcccgcccaactcacgaaccttaatgagttgggttatttaaccatgacgccggtgcaggccgccgcgcttccggcgatccttgccggaaaagatgttcgcgtgcaggcgaaaaccggcagcggcaaaacggcggcttttggcctcggcttgttacagcaaattgatgcgtcgctatttcaaacccaggctttagtgctgtgtcctacgcgtgaactggcggatcaggtggcaggtgaattgcgtcggctggcgcgttttctgccaaataccaaaattttgacgttgtgcggtggtcaaccgttcggtatgcagcgtgattcgttgcaacatgcgccgcatattatcgtggcaacgccggggcgtttgctggatcacctgcaaaaaggcacggtatcactggatgcgttgaatacgctggtgatggatgaggccgaccgcatgctggatatgggatttagcgatgccattgatgatgtcatccgttttgcgcctgcatctcgacagacgcttctgttttcggcaacctggccggaagccatcgctgcaatcagcggacgagtgcaacgcgatcctttggcgattgaaattgactcaacagatgctttgccacccattgaacaacaattttatgagacatccagcaaaggcaaaattcctctgttgcaacggttattaagcttgcatcagccatcctcttgcgtggtgttttgcaataccaaaaaagattgccaggctgtctgcgacgcgctgaatgaagtagggcaaagtgcattgtcattacacggcgatttggagcaacgcgatcgcgatcagaccctggtacgttttgctaacggtagcgcccgtgtactggtcgcgactgatgttgctgcgcgtggtctggatattaaatcgcttgagctggtggtgaactttgagctggcgtgggaccctgaagttcatgtacatcgcatcggtcgtacagctcgtgcaggaaatagcggtctggcgatcagtttctgtgctccggaagaagcacagcgggccaatatcatttctgacatgttgcagataaaacttaactggcaaacgccgccagctaatagttccattgcgacgctggaagcagaaatggcaacgttgtgtatcgatggcgggaaaaaagccaaaatgcgcccgggtgatgtattaggtgcactgacaggagatatcgggcttgatggcgcagatattggcaaaatcgccgtgcatccggcgcatgtctatgtcgcggtccgtcaggctgttgctcataaagcatggaaacagttacagggcgggaagattaaaggaaaaacgtgccgggtgcggttattaaaataatgaaatgttgaattgccgggtgcaagagtaaacatcttattcgggattgccggatgcgacgctggccgcgtcttatccggcctccataagagtagcccgatacgcttgcgcatcgggcgctatcctggttatttcacttcaaccacattcagccgtaactcatccaactgattttcatcttcttctggctgccagcccgccggttgtagtgggatctcttcgcgatcaaacgccagatcacccccgttaaccacttcagaaccgtgggtgatgcctttgaaatcgaacaggttggtatcgcacagatgcgacggcaccacattctgcatcgcgctgaacatcgtctcgatacgccctggataacgtttatcccagtcacgcaacatgtcagcaatcacctgacgttgcaggttaggctgtgaaccgcacaggttgcacggaataatcgggaacgcttttgcatcggcaaatcgctgaatatctttctcgcggcagtaggccagcggacgaataacgatatgtttgccatcatcgctcatcagtttcggaggcatacctttcatcttaccgccgtagaacatatttaagaacaacgtttgcaggatatcgtcacgatggtgacccaacgcgatcttcgtcgcccccagttccgttgcggtacgataaaggataccgcgacgaaggcgagaacacagtgagcaagtggttttgccctctggaatcttctctttcacgataccgtaagtattctcttcaacaatcttgtactcaacgcccagcttttcaagatactcgggcagaacgtgttccgggaagcccggttgcttttgatcgaggttaacagccaccagcgaaaaattgattggcgcgctttgctgcaaattgcgcagaatctccagcatggtatagctgtctttacccccggagaggcaaaccatgatgcgatcgccttcttcaatcatattgaagtcagcaatggcttcgcccacgttacgacgcagacgtttttgtaatttgttcaggttgtattgttctttcttactaatttcttgattttgcgacatttaaaagcgactcaattcgttatatggcatcagaagagtatgcgtcatgccggaacgcccagcataagaaatctgatataaaaaactgtggcgtgtatggtacggattagaggggaaaatgtcagcacatttgcgaaatgaatcaaaaagcccgcagcaatgtgcgggcgttagtgtcagcgcacaaccagcacggagcactctgcgtgacgcactacagctgcggcgttggaaccgagcagataagtggtgatatccggtcgatgggaagcaatgatgatcatatgagcggggatcttcttcgccaattccagaatgcggtctttgggcgagccttcctcaacatggacatgcactctgtcggttggcagtttaaattttttaatgatctcttccagttgcgatttggcttccgctttcaggtcatccattgccggtaattctgcggaatacgctaaacccagagaggcatagtagggcagtgaaggtattaccgtcaggaaatgaacctctgcatcatcaatctttgcctcttcctcaacgtggctaatcacgcgttgagttaattctgaatcggaaatatcgatagggacaagaatcgttctgttcataaaacctcctgttttagtatccgcataaagtgtaacgccagatgacactttttgtgtaatgacggagttcacatttttaatttagatcaaaggaggaagaataagcagaaaaagcccgccataacagcgggcaggaggatttagaactgataaaccagacctaaagcgacaatatcatcggtagagatgccattggcagcgtagaagctgtcatcttcatccaacaggttgattttatagtcaacgtaggtggacatgtttttattgaaatagtaagtcgcgccaacatcggcgtatttaaccagatctttatcatcaacacctgccgggttgtctgcaccacccgcagcgtgcaggtcacggcctttagacatcaggaaagagactgccggacgcagaccaaaatcaaactggtactgtgcagtgacttcaaaattctgggttttgtttgccacagcataatcgctgtcgccaaacggggtcatattacgcgtttctgaatacatggttgccaggtaaatattgttagcatcgtattttagcccagcagtccacgcgtctgctttatcaccacccgccgcagtatggttaacctggtcattggtgcggtcagaagaggtgtatgccgcaccagcgctaaagcccatgcctaaatcatatgttgtggaaagaccccagccgtcaccgttttcatggcgaacatcacgtccgttgttggtgccttcctgaccattactggctccttcgttgttaccttgatactgcaccgcgaagttcagaccatttaccagaccgaagaaatcagtattacgataagtcgcgacgccattggctcgaccagtcataaagttgtctgcattggtataagagtcaccgccaaattcaggcagcatatcggtccagccttcgatgtcgtacattacgccataattacgtccgtaatcgaaagaaccgtaatctgcaaatttcagcccggcaaatgccagacgggtccatgactggttttttgaagattcagtgttgtttgcctgaatattgtattcccattgaccgtagccagtgagttgatcgttaatttgggtttcgcctttaaaacccagacgcgcatagctctggtcgccatctttcgctgaattatcagaaaaataatgcaggccatcaactttgccatacagatctaatttgttgccgtctttattataaacttcggctgcatgtgcagcacctgcggcgagcagggcaggaattaaaagtgccagtactttgcttttcattgaataaatcctttagttattttatttgccttttatccccatttcggggagtgaaaacatcctaaaggagaagttcagttagccgataaatatcatttgttacgccttaagtaaaaccttaatcaaataattcctctgaaatgataataagtctggtgaatgtatcgaagataatacatacaaaataaaaattatacttttaatttgctatacgttattctgcgcgggttatatgcctttattgtcacagattttattttctgttgggccattgcattgccactgattttccaacatataaaaagacaagcccgaacagtcgtccgggctttttttttagaattggataatccttatccagagcatttaatcggtgttgcttttttccgcttttccggccatttgtgccaggaagtcatagcgtttttgcaaatcagctgcagcatctttccataactgttctgccacttctggctgctgcgaattcagccgacggaaacgttgctcgtgaagtaacgtttcttccagtgcttctgacggcgggcgtgaatccaaggccagcggcagtttgccttcatcggcacgacgcggatcaaagcgatatagcggccagaagccggtagctgtgagttggcgcatctggtcgtggctgagtgccagatcgtaaccatgctcttcacacgggctataagcaatgatcagcgatggccccggatacgcttccgcttcctgaatcgctttcaccgtctggttcagctgcgcgccgagagaaatctgcgccacataaacatgaccgtacatcatcatactgacgccaagatctttacgcgctttacgtttgccgtgctcgccaaatttagttactgcacccagcggtgtcgctttcgacgcctgaccaccggtgttggaatagcattgcgtatccagcaccagaatgttgacgttttccgtcaaactcaatacatgatccagaccgccaaagccgatatcgtaagcccagccatcaccaccaatcagccagattgatttttccaccagtgcatctgcatcacgtagcagttcatgtgcttcggcaacatcgttgagttgctggcgtaaagctgcaacctgttcacgacgaacctctggcgtggcgtctgatttcaacgccgtcagtaattccgccgggattttatcggcaaattgatccagcagacgcagcacgcggacacggtgttgatcgaccgtcaggcggaaaccaaggccaaattcggcattatcttcaaatagagagttcgcccatgccggcccacgaccgttggcatcggtggtatacggtgtagagggcaggttaccgccataaattgaagaacagccagtggcgttagcgatcaacatccggtcgccatagagctgagtcagtaatttaatatacggcgtctcgccacaaccggagcaagcacctgaatattcaaacagcggtgtaatcagctgcgatgtacgaatatcaatacgttccagtttgctacggtcgatttctggcaggttgaggaagaaatcgtaattgattttctcttcttcgacatgttccaggcgagacatcatattgatggctttaatctctggattctgacggtctttcgccgggcaaacttcgacgcacaggttacaaccggtgcaatcttccggtgccacctgcaagacatatttctgcccgcgcatatcacgcgatttcacatccagcgaatgcaggctggcaggggcgttttccatcgcttcaggcggcaccacttttgcgcgaatagctgagtgtgggcaagcggcaacgcagtggttacattgggtacagagttcctctttccagatggggatctcttcggcgatattgcgtttttcccagcgcgtagtgcccatcggccaggtgccgtctggcggcagcgccgaaacggggagggcgtcaccaagcccggcgagcatcgcagcggttacggttttcacgaaatcaggggcggcatcggaaaccactggcggtcgattggcgctgtgcggatttaccggttgcaacggaacttcttctacggattcacgcgccagcgccagagcctgccagttgcgttccaccagatcctggcctttgctactgtaacttttggcaatcgcaccctgcaattctgcgagggcgctatcgccaggcagaatttgcgtcagatggaaaaaagccatctgcatgacggtattaatacgggccgccaggccacattcgcgggcgattttcgccgcgttaatcacatagaagcgcgcttttttttggtttaacacggcctgaacttcttgcggcaagcgcgaccacacttcatctgcgctgtacggtgtgttgagcaggaaaatgccgccaggttttaaacgctcagccatctgatatttatcgataaactgcaactggtggcagccaacaaaatcagcctgggaaatgagataagcggaacgaatcggctgttcgctcactcgaaggtgagaaaccgtcaggccgcccgcctttttggagtcgtaaacaaaatagccctgtgcgtaccacggcgtggaattaccgataatcttgatattgtttttggtcgcggaaacgctgccatcactaccaaggccataaaacaaggcttccagtttcgccgagtttggcagggtgttttccggcaacggcagtgacagattagtcacatcatcgtaaataccaaccgtaaagcgcgctttcggtttagccgcgttgagctcggcaaataccgccagtacacagtccgggccaaattctttggatgaaagaccatagcgcccaccaatgacacggggcagagtttcgcgctcgccattattaaaggcttctgccagtgcggtcatcacatccagatagagcggttctgcctgggcaccgggttctttggttctgtccagtaccgccacgctgcgtacggatcccggcagagcttgcagtaaatgtttagcggagaaggggcggtacaggcgaactttcagcacgccgacattttcgccacgggttagcaattcatcaatcacttcttcacaggtgccaatggcagagcccatcaggataatcacccgttccgcttgcggatgcccgtaatactcaaacggctgatactgacgacctgtcgcggcagcgaaatcattcatcgcctgttcaacatggtcatagaccgcgttgtaccaggggttggtggcttcgcgagactggaaataagtgtcaggattggcggacgtaccgcggatcaccggatgttccgggttgagcgcccgggcgcgatgagcatcaatttcggcctgcggcatgagatcaagaatagtgtcatcggccagcgggacaattttattgatttcgtgggacgtgcggaaaccatcaaagaaatgaataaatggcacgcggcttttcagcgtcgcgatgtgcgaaatgagagcaaagtcttgcgcttcctggacgtttgccgcacacaacatcgcgcaacccgtctggcgcaccgccatgacgtcggaatgatcgccaaaaatagagagtgcatgtgtggcaacggtacgtgccgctacatgcaggacaaacggtgtgagttcgcctgccagtttgtacagcgtcgggatcatcagcagcaaaccctgcgatgacgtaaacgatgttgaaagggcacccgtctgcaaagcgccatgcacggtagcgatagcacccgcttccgactgcatttcaaccacgcgtggtgtgtctccccaaacgttcttcaagccgtttccggcccaggcatcagcctgttctgccatcgtggaactgggggtaatagggtagatggcgataacttcactggtgcgaaacgccaccgaagcaaccgcgccattaccgtcaatagtaatcatatgacacccttacattgcgcaaatgaggggcgcacgaaattgctgcgcgcccagtagtaatctttcaattttagcaaatggctttcttctgcattttcgcttttgtgtcccccacatcagcgtaatgaatgttttgatcaaacagagggcaaaaaaatagccataaaaaagtaaaaatgcggggcaacgcgcaggacagctctcgacgtcgccctctgtgctgcctattatttatggcggtgtcgtttggcttgaagatcagaggaagaagagatgcgagcagcgttttgggtagggtgtgccgctttattgttgtcggcgtgtagtagtgagcctgttcagcaggcgactgcggcgcacgtagcgccaggtttaaaagcgtcgatgtccagtagtggagaagcaaattgtgcaatgatcggcggttcgctttctgttgcccgtcaactggatggtacggcgattgggatgtgtgcattacccaacggcaaacgctgtagcgaacagtcacttgccgccgggagctgtggcagctattaattcattaaatccgccagcttataagttaatgtctgtttcgcggtcgccagcgttaactggttcgcggtcagatccacttgtgcaccttctttcagcatttcgctaatggtgttatcgagttcattaagctgcgggttagcgcacatcatacgggtcattgccagccctttggctgtcagttcaccattagacagtttgccttcaccgctaaagcggttacacatgctgccggaaatcatcattttttcaccaaagctgatttctggcggatttttatcgctggtcacgggcttaccgtttacgctttccagcacaaagcgatgatgctgtagctgttctggcgtaacagcaattttgtcattacttacacatcccgccatcagcaggcttagcgcaacaaacgcggctactttcttcattgtggttctcaattacagtttctgactcaggactattttaagaatagagaatgaaaggtcattggggattatctgaatcagctcccctgggttgcaggggagcggcaagattaaaccagttcgttcgggcaggtttcgcctttttccagattgcttaagttttgcagcgtagtctgagaaatactggtcagagcttctgctgtcaggaatgcctggtgcccggtaaacagcacgttgtggcaggcagacaggcgacggaatacgtcatcctggatcacgtcgttggatttatcttcaaagaacagatcgcgttcgttctcatacacgtccatacccaacgaaccaattttctgatttttcagcgcttcaattgctgcctgagaatcaatcaatgcaccgcgactggtattgacgatcatcacgccatttttcatctgatcgaaggcggcttcgttcaacagatggtagttttccggtgtcagcgggcagtgcagagagataacgtctgattcagagaacagggttggcagatcgacatactccacaccgagttccagcgccgctgcacttggatacggatcgaacgccagcagacgcataccaaaacctttcagaatgcgcagcatcgccacaccgattttaccggtaccgataacgcctgccgttttgccatacatagtaaagccggtcagaccttccagagagaagttagcgtcacgggtacgctgatacgcgcggtgaatacggcggttcagcgtcatcatcataccgatggcgtgttcagcaacggcctctggatcataggctggaacacggactactttcagccccagttcttttgccgcgtcaaggtcgacgttattgaaaccggcacagcgcagggcgatatatttaacgccgtgctttttcagctcttccagcaccgggcggctgccgtcatcgtttacgaaaatacataccgcttcgcagccattggcagttttagcggttttttccgtcagcagaaagtcaaaaaattccagctcaaagccaaaggactcgttcacctgttgcaggtacttcttgtcgtactgttttgtgctataaacggcgagtttcataagactttctccagtgatgttgaatcacatttaagctactaaaaatattttacaaaatttcaaatataattgaaagctatggcgatattgaaaaattcatcaacaactatgcttagtgtaggcgcaaccttcaactgaacggttaaacatgccacaatacccgtattgaatgcttaatttttcgctaaatcaggatattaactacccatgctgggtaaatataaagccgttctcgcgctgttattactgattattcttgtgccgttgacgctgctgatgacgctcgggctgtgggttcccacgctggcgggcatctggctaccgctcgggacacgtattgcattagatgaaagcccacgcattacgcgtaaaggtttaatcattcccgatctccgttatctggtgggagattgtcagcttgcgcatatcaccaacgccagcctttcacatcccagccgctggttattgaacgtcggcatggtagaacttgattctgcttgtctggcgaaattgccgcagacggagcaatcgccagctgctccaaaaaccctcgcgcagtggcagtccatgctgcctaacacctggatcaatatcgataaactgattttttctccctggcaggaatggcagggaaaactctctctcgcattaacctctgatatccagcaactgcgttatcagggcgaaaaagttaaatttcaaggccagctgaaagggcaacaacttacagtcagcgaactggatgtcgtcgcgtttgaaaatcagccgccggttaaactggtgggggaatttactatgccgctcgtgccggatggacttcctgtaagtgggcatgctactgcgacgttaaacttgccgcaggaaccgtcactggtggatgcagagctggactggcaggaaaatagcgggcaattgattgtgctggcacgggataacggcgatccgttgctcgatttgccgtggcaaattactcgtcaacaattgaccgtaagcgatggtcgctggagttggccgtatgcaggttttcctttgagtggccgactgggtgtcaaagtcgacaactggcaggcagggcttgagaacgctctgatcagcggacgactgagtgtgctgacccaggggcaagcgggtaaaggcaacgcggtgctaaattttggcccaggaaaattaagcatggataacagccagctgcctctgcagctaaccggtgaagcgaaacaggcggacctcattttatatgcccgcttacccgcgcagctaagtggaagtctgactgacccaacgctggcctttgagccaggcgcgttattacgttcgaaggaaagagtcatcgattcgctggacatcgatgaaatccgctggcctttagcgggtgtaaaagtcacccaacgtggtgttgacggacgtttgcaggccatcttgcaggcgcatgaaaatgaactgggcgatttcgtgctgcatatggatgggctggcgaatgattttctccctgacgctggccgctggcagtggcgctactggggaaaagggagttttacaccgatgaatgccacctgggatgtcgcaggaaaaggtgagtggcatgacagcacgattacgctgaccgatctctccaccggtttcgaccagttacaatacggtacgatgacggtagaaaagccgcgattaattctcgacaagcccgtcgtctgggtacgtgacgcacagcatccctccttcagcggcgcgctgtcactggacgccgggcaaacgctgttcactggcggcagtgtgttaccgccatcaaccttaaaatttagcgtcgatgggcgcgatccgacctatttcctctttaaaggcgatttacatgctggtgagattggcccggttcgggtaaacggtcgctgggacggtattcgtctgcgcggtaacgcctggtggcctaaacaatcactgactgtattccagccgctggtgccacccgactggaagatgaacttacgcgatggtgaactgtatgctcaggttgcattttctgctgcgcctgaacaaggattccgcgcgggagggcacggcgtgttgaaaggcggtagtgcctggatgccagataatcaggtgaacggtgtcgattttgtcctgcctttccgttttgccgatggagcctggcatctggggactcgcggccccgttacgttgcgaattgccgaagtgattaatctggtgacagcgaaaaatattacggctgatttgcaagggcgttatccgtggactgaagaagaacccttgctgttgactgatgttagcgtcgatgtgttaggcggtaacgtactgatgaaacaattacgtatgccgcagcatgacccggcgctgttgcggctgaataatctctcatccagcgaactggttagcgccgtcaatccgaaacaattcgccatgtccggggcatttagtggtgcattgccgttatggctaaacaacgaaaaatggatagtgaaagatggttggctggcaaacagcgggccaatgaccttgcggctggataaagacaccgcagatgcggtggtgaaagacaatatgactgcgggttcagcaattaactggttgcgctatatggaaattagccgttcatcgacaaatattaatttagataatctcggtttattaaccatgcaggccaacattacaggtaccagtcgcgttgatggtaaaagcggtacggtaaaccttaattaccatcatgaagagaatatttttacgctgtggcgcagtttacgctttggcgataatctccaggcatggttggagcagaacgcacgtctgccgggaaatgactgtccgcaaggaaaagagtgtgaggaaaaacaatgaaaattttactggctgcgttgacgtcatcttttatgctggttggctgtacgcctcgcattgaagtcgctgcacctaaggaaccgatcactatcaatatgaacgttaaaattgagcatgagatcatcatcaaggcagacaaagatgtcgaagagctgcttgaaactcgtagcgatcttttctgaggcgatgatgaagaaaacattacttctttgtgcgtttcttgttgggctggtaagcagcaatgtaatggcattgactctggatgaagccagaactcaggggcgagtaggtgaaacattttatggttatttggttgcgctgaaaacggatgctgaaacagagaaattagtaaccgacattaatgccgaacgtaaagcgagttaccaacaactggcaaagcaaaataatgtgtctgcagatgatatcgcgaaactcgccgggcaaaagctcgtagctcgggccaaaccgggggaatatgtacaagggataaacggtaaatggatgcgaaaatcttaatagcaaaaccgcaatatcgggataacgctacaggagaaggcgattaatctattttccggaaacaaggtgaatattcaaaaactcctgtcaaattgccttttgccctgaaatatgcgtagtcaaatatctgttttaactaattggcgttgcagtacatgcaacgcgaattagttagcggaatttacgtcgatactcgcctggcgtcatcccaaagcgttgcttaaataccgttgaaaaatgactctggtcagaaaatccccaatgaaagccgatgcctgccagtttttcatcatctgcggcatggcgaatcgcatctgcacaaaaatcgagacgacggttacgaatatattgcgcgacgaccaaacctttatcggcaaacattcggtacaaactacgtactgacatacccgtctctgcggctatccactccgggcgtaatatctcttcgcgaatattatcgtctatcaacgtaaccactttttgaaactgacgttcacggcgaggttggacagattcccgctgatgaagtaccgggcgcagcagacacaccatcgcctgtagcgcagcttcactttctgtttcagaaagtgccgggttattcatgctttcctgtaacagacgatgactgagttgcaccatgggtaagtcagcgtccagtctttctgcgcagacaggtttttgatggggaaaatattgttccagcagagtgcgtggcaaaagtaatgaaatctgtttagaagactcctgccagtaaagcgaacaggggcgtgaggcatcgagtaacgtaatatcgcctgcgccaatctgcacctgacgctcatcctgctccattattgcctgaccactaagctgaaaaacggtgtaaaaccaggcatcgtcgctgccttttacttcctgccaggtgcgggataaattcaccccgctggttgtcacggtactcagctttagtcctttggcaaaatgcgtgtccagtacacccgtgtaacgctcagtcagcaggcgtccggtaaaatttccgcatacctgattgatttgggaaagccattgctgaaactcattatccactgcggggttcatggcacgttttcgctctgtgaaatgtatttttattgttgcatttgtgttgcgataaacgaagctaatgagcctgactataggaaataagtcttgtcaggcatagagacataagcggttattgtcacgatttgcggagcttgtcacagctgacaaagcgaatgtcacagcgaaaaaagtgacttttcttgtcgctgcgtacactgaaatcacactgggtaaataataaggaaaagtgatgacagagccgcatgtagcagtattaagccaggtccaacagtttctcgatcgtcaacacggtctttatattgatggtcgtcctggccccgcacaaagtgaaaaacggttggcgatctttgatccggccaccgggcaagaaattgcgtctactgctgatgccaacgaagcggatgtagataacgcagtcatgtctgcctggcgggcctttgtctcgcgtcgctgggccgggcgattacccgcagagcgtgaacgtattctgctacgttttgctgatctggtggagcagcacagtgaggagctggcgcaactggaaaccctggagcaaggcaagtcaattgccatttcccgtgcttttgaagtgggctgtacgctgaactggatgcgttataccgccgggttaacgaccaaaatcgcgggtaaaacgctggacttgtcgattcccttaccccagggggcgcgttatcaggcctggacgcgtaaagagccggttggcgtagtggcgggaattgtgccatggaactttccgttgatgattggtatgtggaaggtgatgccagcactggcagcaggctgttcaatcgtgattaagccttcggaaaccacgccactgacgatgttgcgcgtggcggaactggccagcgaggctggtatccctgatggcgtttttaatgtcgtcaccgggtcaggtgctgtatgcggcgcggccctgacgtcacatcctcatgttgcgaaaatcagttttaccggttcaaccgcgacgggaaaaggtattgccagaactgctgctgatcgcttaacgcgtgtaacgctggaactgggcggtaaaaacccggcaattgtattaaaagatgctgatccgcaatgggttattgaaggcttgatgaccggaagcttcctgaatcaagggcaagtatgcgccgccagttcgcgaatttatattgaagcgccgttgtttgacacgctggttagtggatttgagcaggcggtaaaatcgttgcaagtgggaccggggatgtcacctgttgcacagattaaccctttggtttctcgtgcgcactgcggcaaagtgtgttcattcctcgacgatgcgcaggcacagcaagcagagctgattcgcggatcgaatggaccagccggagaggggtattatgttgcgccaacgctggtggtaaatcccgatgctaaattgcgcttaactcgtgaagaggtgtttggtccggtggttaacctggtgcgagtagcggatggagaagaggcgttacaactggcaaacgacacggaatatggcttaactgccagtgtctggacgcaaaatctctcccaggctctggaatatagcgatcgcttacaggcagggacggtgtgggtaaacagtcataccttaattgacgctaacttaccgtttggtgggatgaagcagtcaggaacaggccgtgattttggccccgactggctggacggttggtgtgaaactaagtcggtgtgtgtacggtattaatcttgttcgctcataagtaaaaaacggcacctggtgccgtttttttagtctgaaacaatcaattatctttcttcagcgcccctagcgttggcgtttcgtcaaagaagttccatggtttcagcagagtatgtacccattcggtcggcataatcggccactcttcggcgcgggccacatgtgtggtgccggtggtcatccagacaacggcgtcggtgttgtccagcgactcgttatccttactgtattgtccaagaccggtgtcatgagtagaacggttcggatatttgccttccgggaaacgctcgccaggatgataacgcgttacccaaagctgcttgtccataaagcttaaacgatgatagatccactcgtccggcgcgaactgggcaccttttgctaccgggtgagtaccacctgcataaggaataatttgataggaaactggattgcccatgcggttctctttgttcgggttactcaacagacgaatcgtgcccggatcaaatttctgtgcggcatcctgttcattgccgatgttgtactgattaacttgcatggtactggtgcgtgggccaccggcagtattcggttttaccactgggtccatcgccaccaggctgttattctcgccatctacatccagatcgaggcggaaattataaatatgttggtgtgtagtacccacgatattgtgatcgataagcgtgccgtagcgcgtgtcatctttcgccgtctcatcgtgcatggttttcgctttaacacctttcaccgcttcgatgcccgtagcaccggcatcgatgccaatagtgccgttttcatggaagatccagtcaaaaatgtagtcatagttacccactgtactgatccagcgcaccactaactcccggcgttcggtactgacgttgggctggcccatttcctgatgcttatactccggcccggcataacgttcaaataccgcgatagcgcgagggatctccatcggcacgccagtgtagtcggcgatggtttcattaaggagcactgcgttagacggggcatctttaccacgagcaattggtgaggttagcgtgcccataccgtagtcaccagagtccagatacgctttaaagtaccagccaatatcaggatcaccgtaaggcacaatcatgccgccgagagaaccttcgtacatgactttgcgtttggtgccattgtcgttataagtcacggtggagatcatcggcccgacgcgagagttcatgctgaggtgaaaatcccagttccgccagtgaatcatatcgccagtaatggtgtaatttttaccttcaggctcaatgatttgcataggcttaactgccggagcaacgcggtcacggccatcaaatgggcgtgcggtcattggcaccggaactaccggaccttcttcaatcttaacgatttttttctgttctaaatcaacgaccgccaccaggttttcgatgggatgtgcccagtagttgccatcaccgacatcaagatagctgatgactttgagcaaccgggcatcttgtttcaggccatctttaccatcgaaataacctacggtcagcggcgtggtaatcacttttttcgcatcagtaataccgcgtttcttcacggcagcggcaaattcttcactgttgttaataatgttctgcacactggcgaaatcatccagcaacaccataccgtgggcgtctttaatgggttgccaggagagcagtttgttgttttgcagatccaccaccgcttcgatgatatgtttgccgtcgagcataatgacgtcggctttgcgcggctggtcaaccggtttgttttccagcgcaaacgcccagacagcttctttatctggcggtagcagggagatctcagtaaaacgggtattgggtttgaagtccgcggaagctttaacaatttcaacggcctgtttaatttcgtccgcagttagcgcattaagtgggtgagggcgcttttctacctgaaaggtttgatccagcccggactggaaaacatcgttaataaaggtgtcagaaacccaggctttattgtctttcatcactaccggtacttgcagtgccagaggctgaccattaacaattgctgtttgcgcaccaggcttcactttcacgtacgcgccatctttaatcagggtaaagagctgggcgtagtcgtcccactgcacatcggcaccaaattctttaagcgttttatccattggcaccatatgcgcttcaccaccgtgggcaaataccggcgcttgccaggcgaaacttaaggcgactgccaacgccagggttgttttacgggcagaatacagagaggggcttcccattattaacctcgtcagatgttgtgttcttgttagcaaccgcgctctgtgggcggtttagtcaggttcacattatcagtactgatgcaaaggggattgcctgcacctgccaggttgtttggcaggtgtgccagcttttcatacagtggatgccctgaaaatagatgtacacatcatgcataatgtgacaacgtcacaaaacttagtgaaataaaagggcaactattcgccgttgcccttcattcaccgattaatcgacaaaatcaccgtgctgcctggccaccagcgtcagaattgaatacagcgccaccggggtttgatgctgattgaatacctctacagcccattccaccacacctgttggtttttcttctgcgctacgctgttttttcagcgtcttgcgcttacaggtgagacgcacctggatggtatcgcctggctttacgggttcgataaaacgcaagctttccagcccgtagttagcaatgaccggaccgacaccgtcatcgacaaacagacccgcagccgcagaaagcacaaaatacccatgcaccacccgctcaccgaaaatagattcggcagcagcaatcttatccatatgtgcatagaaatgatcgccgctgaggcaagcaaagttaacaatatcggcctctgtcattgtgcggcggggagtcagcaggctgtcgcctggttgcagctcctcaaaatatttgcggaacggatgaatacgatcttcttcgactttcgcaccacgcacccactgtttactgatagcggcaagcatcgacgggctaccctgtatagcggttcgctgcatgtaatgtttcaccgctcgtaaaccacctaattcttcaccgcctcctgcgcgaccaggcccaccatgtaccagttgtggcagtggggagccatgcccggtggattcttttgccgactcttcattgaggatctgaattcgcccatgcgtacgtgccgcgtcggcaataaactgacgcgcaatttgcggatcagccgtcaccagcgttcccgcaaggctaccgccgcctgcacaagccagttgcagagcatgttgctggttttgtgctggcatcagcgttgcgacagggccaaaggcttctgttgcatgtaccgccggtgtttcatccggctgcggacagtacaataaggttggcgggaagaatgcacccgcagcagataaatccgcctgaccaccgaggcgaatctcgcatcctgcagccagcaatgtgttcactttttcctgcacatcagcacgctgttcagcatttaccagtgcgcccattttcacaccttcctgtgcaggatcaccgaccacgactttctgtaatcgcgcaaccagagcatcactgacagcattaaccaatgcctgcggcacaataatccgccggattgccgtacatttttgcccggcttttgtggtcatctcacgcacaacttcacgaataaacagcgcaaactccggttgatccggggtgacatcttcgcccagtacgcagcagttcagggaatcagcttccatcgtgaaggggatagatttggcaacgatatttggctgaactcgcagcatctgtccggtcgtcgcggaccccgtgaaagtcaccacatcctggctgtccagatgatccaaaaggtcgcccgcactaccgcagatcagactaattgcgccttcgggaacaagaccactatcgacaattgatttcaccatcgcctgagtcagttgggccgtcgcggtagctggtttgatgatggctggcattccgcccagccacgttggtgccagcttttccagcattccccagcaggggaagttaaaggcgttaatatgcactgccacgcctgactttgaggtcagtacatggcgcgcggcaaatccaccttctttcgataaggggatcaattcatcttccggccacagcgtatcgtcaggcagctcccggctaccgaggctggcgtaagtaaataacgtcccaataccgccttcaatatcaacccaactgtctgcccgcgttgcgcctgtttgcgcagaaagagcatagaagcgctctttttcactcagcagatgtttagcgaccgctttaagcatcgccgcacgttcgataaaggtcatcgcgcggagggcgggggcacctttttcaatggcaaactggcgggcagccgccatatcaagaccttcactggtcacttcccataatgcctcgccgctaatggcgtggtgaatcaaacggctacggccccggccagactgccaggtaccggataagaaactgtctaactgctgcatcgctactctccagatgtttcacatttctgttgctaatagttaaatcgcgaatcataaaaagcaagggatcttttaacgaaatgttaactatgcgatctgtatagcaactgcggaaaacattaatgcactgataaataatgatttataaaaatatggtgcgaaatccgtcacagttcaaacatacaaaatttgtgattttagttaaccattgtgtagcttttacaaaacaatgtgattcgtgtttttaattaaatcacaaaaactggaatcgtaaaggtgatgacgtgacccaagaagaacgctttgagcaacggatagcccaggaaacggctatcgagccgcaggactggatgcccgatgcttaccgaaagacattgatccgccagattgggcagcatgcgcactccgagattgttggtatgttgcctgaaggtaactggatcactcgcgcaccaaccttgcggcgtaaagccattctgttagccaaagtgcaggatgaagcaggtcatggcctgtatctctatagcgccgccgaaacactgggctgcgccagagaagacatctaccaaaaaatgctcgacggacggatgaaatattcctccatctttaattatccgacattgagttgggctgatatcggtgttatcggctggctggtggatggcgcagcgatcgtcaatcaggtggcgttatgccgcacttcttatggcccgtatgccagagcaatggtgaaaatctgcaaagaagagagttttcaccagcgtcaggggtttgaagcctgcatggcactggcgcagggcagcgaagctcaaaagcagatgttgcaagacgccattaaccgtttctggtggccagccttaatgatgttcgggccaaacgatgataactcgccaaacagcgccagaagtctcgcctggaaaatcaaacgtttcaccaacgacgaactccgccagcgtttcgtggataacaccgttccacaggttgaaatgctcggtatgaccgttcctgacccggatctgcattttgatactgaaagcgggcactaccgctttggtgagatcgactggcaggagtttaacgaagtgataaacggtcgcggaatttgtaatcaggagcggctcgacgccaaacgtaaagcctgggaagaaggtacctgggtacgggaagcagcgctggcccatgcacaaaaacaacatgcccgtaaggtcgcataaggagattcaaaatgagtaatgtttactggccgttatacgaagttttcgtgcgtggcaaacagggcttatcacaccgccatgttggcagtttacatgctgccgatgagcggatggcactggaaaatgcccgtgatgcttacacccgtcgtagcgaaggatgttcaatttgggtggtgaaggcgagtgaaattgttgcctcgcaaccggaagaacgcggtgaattttttgatccggctgaaagcaaggtctatcgccatccaacgttttactccatccctgatggcattgagcacatgtgaggttggaaatgaatcagttaacggcttacaccttgcgcctgggcgataactgcctggtgctctcccagcggttgggggaatggtgcggtcatgcaccggaactggaaatcgatctcgcactggcaaacattggcctcgatttattaggtcaggcacgcaacttcttatcgtatgccgctgaattagcgggagaaggcgatgaagataccctggccttcacccgagacgagcgccagttcagcaacttattgttggttgaacaaccaaacggcaattttgccgacaccattgcacgccagtatttcatcgatgcatggcatgtggcgctctttacccgtctgatggaaagccgcgagccgcaactggcggcgatttctgccaaagcaattaaagaagcgcgttatcacctgcgttttagtcgtggctggctggagcgactgggcaatggtactgacgtatcagggcaaaagatgcagcaggccatcaacaagttgtggcgttttaccgccgaactgttcgatgccgacgagattgatattgcactgagtgaagagggtattgcggttgacccacgcactttacgcgcagcgtgggaagccgaagtttttgccgggatcaacgaagccacattgaacgtaccgcaagagcaggcgtatcgcactggcggtaaaaaaggactgcataccgaacaccttgggcccatgctggcagaaatgcagtatctccagcgtgtcttgcccggtcagcagtggtaacagaggagatgggtatgcaacgtctggccaccattgcaccgccgcaggtgcatgagatatgggcgctactcagccagatcccggacccggagatcccggtgctgaccattaccgatttaggcatggtgcgtaatgtgacacagatgggagaaggatgggtgatcggctttacgccgacttattccggttgtccggcaacggaacatttgattggcgcgatacgtgaggcaatgacaacccacgggtttacccccgttcaggttgtgctgcaactcgacccggcatggaccaccgactggatgacccccgatgcccgtgagcgtctgcgacagtatggcattagcccgcccgccggacacagttgccatgcccatttgccgccagaagtacgttgcccgcgctgtgccagcgtccataccacacttatcagtgaatttggttccacggcctgcaaagcattgtatcgctgcgatagttgccgcgaacctttcgattatttcaaatgtatttgaggatgccatgacaacgtttcattccttaacggtggcaaaagtggagccggaaacccgtgatgcggtgaccattacctttgcggtgccccagcctttgcaggaggcgtatcgctttcgccccggtcaacatttgaccttaaaagccagctttgatggtgaagaattacgccgttgttactccatttgccgcagctatctgcctggcgaaattagtgtggcggtgaaagccattgaaggcggacgtttctcccgctatgcccgcgaacacatccgccagggtatgacgctggaggtcatggtgccgcaggggcatttcggctatcagccgcaggccgaacgccaggggcgctatctggcaattgcagcaggatcaggtattacgccaatgctggcgattatcgccaccactttacaaaccgagcctgaaagtcagttcaccctgatctacggtaaccgtaccagccagagcatgatgtttcgccaggcactggcagacctgaaagacaaatatcctcagcgtttacagttgttgtgcattttcagtcaggaaaccctcgacagcgatctgcttaacgggcgtattgacggtgaaaaattacagtcacttggggcctcgctcattaattttcgtctttatgatgaggcatttatttgtggtccggcggcgatgatggatgacgcggaaaccgccttaaaagcactgggaatgccagataaaaccattcatctggagcggtttaatacgcctggcacgcgcgtcaaacgtagcgttaacgtgcaaagtgacggacaaaaagtgactgtacgtcaggatgggcgggatcgggaaatcgtgcttaatgccgacgatgaaagcattctcgatgcggcattgcgccagggggcggatctgccctatgcctgcaaaggcggcgtctgtgcgacctgcaaatgcaaagtgctgcgtggcaaagtggcgatggaaaccaattacagtctggaaccggatgaactggccgcaggttatgtgttgagttgccaggcactgccgctgaccagcgatgtggtggttgactttgacgcgaaggggatggcatgagcgaactgatcgtcagccgtcagcaacgagtattgttgctgacccttaaccgtcccgccgcacgtaatgcgctaaataatgccctgctgatgcaactggtaaatgaactggaagctgcggctaccgataccagcatttcggtctgtgtgattaccggtaatgcacgcttttttgccgccggggccgatctcaacgaaatggcagaaaaagatctcgcggccaccttaaacgatacacgtccgcagctatgggcgcgattgcaggcctttaataaaccacttatcgcagccgtcaatggttacgcgcttggggcgggttgcgaactggcattgttgtgcgatgtggtggttgccggagagaacgcgcgttttgggttgccggaaatcactctcggcatcatgcctggcgcaggcggaacgcaacgtttaatccgtagtgtcggtaaatcgttagccagcaaaatggtgctgagcggagaaagtatcaccgctcagcaagcacagcaggccgggctggttagcgacgtcttccccagcgatttaaccctcgaatacgccttacagctggcatcgaaaatggcacgtcactcgccgctggccttacaagcggcaaagcaagcgctgcgccagtcgcaggaagtggctttgcaagccggacttgcccaggagcgacagttattcaccttgctggcggcaacagaagatcgtcatgaaggcatctccgctttcttacaaaaacgcacgcccgactttaaaggacgctaatgatggaattcatcctcagtcatgtagaaaagggcgtgatgacactaacgctcaaccgcccggaacgcctgaacagttttaatgatgagatgcacgcacaactggcagagtgcctgaaacaggtcgagcgcgacgacactatccgttgcctgttacttacaggtgccgggcgcggattttgtgctggtcaggatcttaacgatcgtaacgttgatcccacaggccccgcaccggatttagggatgtcagttgaacgtttctataacccactggtacgtcgcctggcaaaactgccaaaaccggtgatctgtgcagtcaatggcgtggcggcaggggcaggcgcaacactggcactggggggcgacatcgttattgctgcccgttcagcaaaattcgtcatggcgtttagtaagttaggcttaatacccgattgcggtggaacctggttactgccacgcgttgccggacgagcgcgcgccatggggctggcactgctggggaatcaactgagtgctgaacaggcgcacgaatgggggatgatctggcaggttgttgatgatgaaacgctggcagataccgcgcaacagctggcacggcatctggcgacacaaccgacatttggtcttggacttatcaagcaagcgataaatagcgctgaaaccaatacgctcgatacgcaactggatctggaacgtgactatcagcgacttgccggacggagcgcagattatcgtgaaggtgtcagtgcgttcctggctaaacgctcaccgcagttcacggggaaatagcatgatgataaatgtgcaaactgtggcagtgattgggagcggcaccatgggggcaggcattgctgaagttgccgccagtcatggacatcaggttttactgtatgacatttctgctgaagcgctgacccgcgcaatcgacgggatacacgcgcggctaaattcacgcgtgacgcggggaaaactgaccgctgaaacctgtgaacgcacattgaaacgcctgatcccggtgaccgatattcacgcgctggcagcagcgaatctggttattgaagcggcgtctgaacgtctggaagttaaaaaagcgctctttgcacaactggcggaagtttgcccgccacaaacgctattgaccactaacacttcgtcaatctctataaccgcgattgctgcggaggtaaaaaatcctgaacgtgttgcggggctgcatttttttaacccggcaccggtgatgaagttggtggaggtggtcagtgggctggcaacggcagcggaagttgtcgagcagttgtgtgaactgacattgagttggggtaagcagccagtgcgctgtcattcgacccccggatttatcgttaaccgtgttgcgcgtccttattattccgaggcctggcgggcactggaagagcaggttgctgcaccagaagtgattgacgctgcacttcgcgatggcgctggtttcccgatggggccgctggaattaaccgatctgattggtcaggacgtcaattttgctgtcacctgttcggtgtttaacgctttctggcaggagcgtcgttttttaccttcgctggtgcaacaggaactggtgattggtggacggttgggcaagaaaagtgggctgggcgtgtacgactggcgcgcggaacgtgaggcagttgttggcctggaagcggtaagcgacagttttagcccaatgaaagtagaaaagaaaagtgacggtgtcacggaaattgacgatgttttattgattgagacacaaggcgagacggcacaggcgctggcaatacgactggcacgcccggtggtagtgatcgataaaatggcgggcaaggtggtgaccattgctgctgcagcggtgaacccggactcagcgacccgcaaggccatttattacctgcaacagcagggcaaaacagtgctgcaaattgcagattacccaggaatgctgatttggcgaacggtagcaatgatcatcaatgaagcccttgatgcgcttcaaaaaggcgtggcctctgaacaggatatcgataccgccatgcgtcttggggtgaattatccatatggcccacttgcctggggagcgcaacttggctggcagcgaatattaaggctccttgaaaatctacagcatcactatggcgaagaacgctatcgcccatgttcattgctgcgccaacgggcgcttctggagagcggttatgagtcataaggcctggcaaaatgcccatgcaatgtatgagaacgatgcctgcgccaaagcgcttggcatcgacattatctcaatggatgaaggctttgctgtagtgaccatgaccgtcactgcacaaatgcttaacggtcatcaaagttgccacggcgggcagctattttcactggctgatactgcctttgcctacgcctgcaatagccaggggctggcagccgtcgcttctgcctgcacgattgattttttacgtccaggctttgccggagacaccttaactgctactgcgcaggtacgtcatcagggcaagcaaaccggtgtttacgacatcgaaattgttaaccaacaacaaaaaacggttgcgctgtttcgcggtaaatctcaccgcatcggcggcaccattacaggagaagcctgatgcgtgaagcctttatctgtgacggaattcgtacgccaattggtcgctacggcggggcattatcaggtgttcgggctgacgatctggctgctatccctttgcgggagctgctggtgcgaaacccgcgtctcgatgcggagtgtatcgatgatgtgatcctcggctgtgctaatcaggcgggagaagataaccgtaacgtagcccggatggcgactttactggcggggctgccgcagagtgtttccggcacaaccattaaccgcttgtgtggttccgggctggacgcactggggttcgccgcacgggcgattaaagcgggcgatggcgatttgctgatcgccggtggcgtggagtcaatgtctcgggcaccgtttgttatgggcaaggcaaccagtgcattttctcgtcaggctgagatgtttgataccactattggctggcgatttgtgaacccgctcatggctcaacaatttggaactgacagcatgccggaaacggcagagaatgtagctgaactgttaaaaatctcgcgagaagatcaagatagttttgcgctacgcagtcagcaacgttcggcaaaagcgcaatcttcaggcattttagctgaagagattgttccggttgtgttgaaaaataagaaaggtgttgtaacagaaatacaacatgacgagcatttgcgcccggaaacgacgctggaacagttacgtggactaaaagcaccatttcgtgccaatggagtgatcaccgcaggcaatgcctccggggtgaatgacggagccgctgcgttgattattgccagtgaacagatggcagcagcgcaaggactgacaccgcgagcgcgtatcgtagccatggcaaccgccggggtggaaccgcgcctgatggggcttggtccggtgcctgcaactcgccgggtgctggaacgcgcggggctgagtattcacgatatggacgtgattgaactgaacgaagcattcgcggcccaggcgttgggtgtactacgcgaattggggctgcctgatgatgccccacatgttaaccccaacggaggcgctatcgccttaggccatccgttgggaatgagtggtgcccgcctggcactggctgccagccatgagctgcatcggcgtaacggtcgttacgcattgtgcaccatgtgcatcggtgtcggtcagggcatcgccatgattctggagcgtgtttgagcatatcaacctgcgagtaccctacaatgataaccaatacaaagcttgacccgattgaaaccgcgtctgttgatgagttacaggcgttacaaacacagcgtctgaaatggacgctcaaacacgcgtatgaaaatgtcccgatgtatcggcgcaaattcaacgcagcaggcgtacatcctgatgatttcagggaactttcagacctgcgtaaatttccctgtaccaccaaacaggatctgcgcgacaactatcctttcgacacctttgccgtgccgatggaacaagtggtgcgcattcatgcttcttcgggaaccacaggtaaaccgacagttgtcggctatacgcaaaacgatattgataactgggccaatattgtagcgcgttcgttgcgtgcggcgggtggcacgcccaaagacaaaattcatgtcgcctatggttacgggctgtttactggtgggctgggtgcgcactatggtgccgaacgtctgggcgctacggtgatcccgatgtctggcgggcagacagaaaaacaagcgcaactgatccgtgattttcaaccagatatgatcatggttacgccatcttattgccttaacctgattgaagagctggagcggcagttgggcggtgatgccagcggttgctcgctgcgggttggagtgtttggtgctgagccgtggacacaggccatgcgtaaagaaattgagcgtcgcctggggatcaccgcactggatatttatggcctgtcagaagtgatggggccgggggtggcgatggagtgtctggaaactaccgacggcccaaccatttgggaagatcatttctatcctgaaattgttaatcctcatgacggcacaccgcttgccgatggtgaacatggcgaactgttattcaccacgctgaccaaagaagcattgccggtcattcgttaccgcacgcgtgatttaacccgactgttaccaggaacggcgcggactatgcgccgcatggatcgcatcagcggacgcagcgatgacatgttgattattcgcggtgtaaatgtctttccgtcacaactggaagaagagattgtcaaattcgaacatttatcgccgcattaccaactggaggtgaaccgccgggggcatcttgattcactttctgtgaaagtggagttgaaagaaagtagcctgacattgacgcatgagcagcgttgccaggtatgccaccagctgcgccatcggattaagtcgatggtggggatctctaccgatgtgatgatcgttaactgtggcagtatcccgcgttcagaaggcaaggcgtgtcgggtgtttgatctgcgcaatattgttggtgcctgacgtgtcgtctggccctggtgaggtaaagcgtcagggccagaagtcgatacgacctgtgctatgattcataaatcacaacaataacaacagactgaatcgaatgagtaaacttgatacttttatccaacatgctgtaaacgctgttccggtcagtggcacatctttgatctcctctctgtatggtgattcgctttcccatcgtggtggtgaaatctggcttggtagtctggctgctttgctggaagggctgggatttggtgagcgtttcgtgcgcaccgctttgtttcgtcttaataaagaaggctggctggatgtttcccgcatcgggcgacgcagtttctatagcctcagtgataaaggcttgcgcctgacgcgacgggcagaaagtaaaatttatcgcgcagagcaacctgcatgggatggtaaatggctcctgttgctctcggaaggtttagataaagcgacgctggctgatgtcaaaaagcagttgatctggcaaggttttggcgcactggcacccagcctgatggcatcgccgtcgcaaaaactggcggatgtacagacacttttgcatgaagcgggggtggcggataacgtgatttgttttgaagcgcaaataccactggcgctttctcgcgcagcactgcgtgccagagtagaagagtgctggcatttaactgaacaaaatgccatgtacgaaacctttattcagtcattccgcccgctggtgccgctgttaaaagagacggcagacgagttaaccccggagcgtgcatttcatattcagcttttactgatccatttttatcgccgtgtcgtccttaaagacccattgttgccggaggagttgcttccggctcactgggcagggcatacggcgcgtcagctgtgtatcaacatttatcagcgcgtagcgcctgctgctttagcgttcgttagtgaaaaaggtgaaacctcagtcggtgaactgcctgcgccgggaagcctgtattttcaacgttttggcggcttgaatattgaacaggaggcgttatgccaatttaccagatagatggtctgactccggttgtgccagaagagagctttgtccatccgacagcggtattgatcggcgatgttattctcggcaagggcgtttacgttgggcctaatgccagcctgcgtggcgattttggtcgtatcgtggtgaaagatggcgcgaacattcaggataattgcgttatgcacggttttcccgagcaggatactgttgtaggagaagatggacatattggtcatagcgctatccttcacggctgcattatccgccgcaatgcattagtgggaatgaacgcggtagtgatggacggtgcggtgattggcgagaacagcattgttggtgcatccgcatttgtgaaagccaaagcagaaatgccagctaattatctgattgtcggcagcccggcgaaagcgattcgtgaacttagtgagcaggagctggcatggaaaaagcagggtacgcatgagtatcaggtgctggtgacacgctgtaagcaaacgttgcatcaagtcgagccattgcgggaagttgaacctggcaggaaacgcctggtatttgatgagaatctgcgaccgaaacagtaacagatgtaaaattattttgtccctttaattataaagcagagttatgtttaagctctgctttatttatttgagtattaattcatgccgttttttcatcatataattatttataatgagaatgtgcttttaatttgtaatttatattatatacataattcatatattcatggtcttttatttattcacctgaattataactgtgcattatcggaaagtatgtttgattaggtaataatctactggcaatataggatgtcttcaatgttttaaataactaattggtcgggttagtgcatccggctttctttatattcgccagaaggatttattatgcaaaggaaaactctattgtcggcctgtattgcattagctctgagtggtcagggttgggcggcagatatcacagaggtagaaaccaccacaggtgaaaagaaaaataccaatgtgacttgtccggcagacccaggaaaactcagtccggaagagcttaaacgcttaccctctgaatgctctcctttagtcgaacaaaacctgatgccatggcttgccacaggcgctgctgcgttaatcacggccttagccgtagtggaactaaacgacgatgatgatcatcatcatcgcaacaattctccactcccaccgacaccccctgatgatgaatcagacgacactccagttcccccaagtcctggcggagatgagataataccggacgatccggatgatacgcctacacctcccaaaccgatttcgtttaataatgacgttattctcgataaagcagaaaaaacgttaactattcgcgattcagtttttacttataccgagaatgctgacgggactatttctctgcaagatagcaatggtcgtaaggcaacgattaatctttggcagattgatgaagcgaataacactgttgcccttgaaggggtgagcgcagatggcgcaacgaagtggcaatataatcataaaggtgagcttgttattacgggtgataatgccacagtaaacaacaatggcaaaaccaccgttgacggcaaggattccaccggtacggaaatcaacggtaataacgggaaagtgattcaggacggcgatctggatgtcagcggcggcggtcacggtattgatatcaccggtgacagcgcgacggtagataacaagggcaccatgaccgttaccgatccggagtccatcggtatccagattgacggcgacaaggcggttgttaataacgaaggcgagagcaccatcaccaacggcggcaccggcacgcagattaacggtgacgacgccacggcgaataacagcggcaaaaccaccgttgacggcaaggattccactggcacggaaatcaacggtaataacgggaaagttatccaggacggcgatctggatgtcagcggcggcggtcacggtattgatatcaccggtgacagcgcgacggtagataacaagggcaccatgaccgttaccgatccggagtccatcggtatccagattgacggcgacaaggcggttgttaataacgaaggcgagagcaccatcaccaacggtggcaccggcacgcagattaacggtgatgacgccacggcaaacaacaacggcaaaaccaccgttgacggcaaggattccaccggtacggaaattgctggcaataacgggaaggtgattcaggacggcgatctggatgtcagcggcggcggtcacggtattgatatcaccggcgacagcgcaacggtggataacaagggcaccatgaccgtcaccgatccggagtccatcggtatccaggttgacggcgaccaggccatcgtcaataacgaaggcgagagcactatcaccaatggcggcaccggcactcagatcaacggtaacgacgccaccgcgaataacagtggaaaaaccactgttgatggaaaagattccacgggtaccaaaatcgcgggcaatatcggcattgtaaatctggatggtagcctgactgttacaggcggtgcgcatggtgttgagaacattggtgacaacggcacggttaacaacaaaggagatattgttgtttccgatactggatcgattggcgtgctcatcaacggtgagggggcaacagtatccaatacgggtgatgttaacgttagcaatgaagcgacagggttcagcatcacaaccaacagtgggaaggtttcgctggcaggcagtatgcaggttggcgatttctcgaccggggtagatcttaatggcaacaataacagcgtgacgctggcggcaaaagatctaaaagtggtcgggcagaaagcgacgggcataaacgtttctggcgatgcgaatacagtgaatatcactggtaacgttctggttgataaggataaaaccgcagacaatgcggcggaatatttcttcgatccatccgtgggtatcaacgtttacggcagtgataataacgtgacgctggatggaaagttaactgttgtatcagacagtgaggttacttctcgtcagagtaatttatttgatggcagcgcagagaaaacgtcaggtctggttgtgattggcgatggcaataccgttaatatgaatggtggacttgaactgattggagagaaaaacgcgcttgcagatgggtcgcaggttgcttccttgcgcacaggatatagttataccagcgttattgtcgttagtggtgagtcgtcggtatatctgaatggagatacgacaatcagcggagaattccctctggggtttgccggggttattcgggtacaggataaagctttgctggaaattggcagtggcgctacgctaacaatgcaggatattgacagttttgaacatcatgggacaagaaccccagaacttacttatgctgattccggtgcgaaaattgttaataaaggtactgttgaaattcagaatttaggttttgcttttgttactggtgaaaatacaacaggtataaatagtggcacgatctcgttattacaaaatggtaaagatccggcaccgtctcccattgttttactggctactaacggagggagcgccactaatgcaggtacgatcacaggtaaagtgacggaacgacatagcgtatttaacaagtattcaacgggcacatcgaattcatttatttttaataacgatgtcagtagcataacagggttagtcgctcaatcgaatagcacaattatcaatactgacagcggcatcattgatttgtatggtcgtggtagtgtcggcatgcttgctatagcagattcaacagcagaaaatcagggtaaaattacactggattctatgtgggtagatgcaaatgacactaccgcaatgcgagatatagctagcaacagcgccattgacttcggtacaggtgtgggagttggtactgatagttatagtggtgcagggaaaaatgcaacagcaattaaccaattgggcggtgttataactatttataacgccggcgcaggtatggcggcctatggcgccagcaatacagttattaaccaggggacgattaacctcgaaaaaaatggtaattatgacgatagtctggcagcaaatactctggtagggatggctgtttatgagcatggtactgctatcaacgaccagacgggtgttatcaatatcaatgttggtactagtcaggcgttttataacgatggcacaggaacaattgttaactatggtacaatctgcactttcggcgtgtgccaatcggggaatgagtacaataacacagatgatttcacctcactgatctataccggtggcgatacgattacacgaagcggagaaactgtaacgctaaataatgccggagaaatgactgcgcaaattaccatgaatgctggtgctgatagttcgttagtgaacaacaccggaactatcaataaaatcgtgcagaacgcgggggtattcaataatagtggcagtgtaacagggcggatgatgtcggctggcggggtctttaataatcaaactgacggggcgattatgagaggtgctgcgctgacaggtactgcagtggcaaataacgaaggaacctggaacctcggaagtagcagtgagggtaacaacaccgggatgctggaagttaataataattctgctttcaataaccgcggcgagtttattcttgataacgacaagaatgctgtgcacatcaaccagtccggtacgctttataataccggtcacatgaacatcagtaattcttcccacaacggagccgttaatatgtggggcggaaatggtcgttttatcaatgacggaacgattgatgtttctgcgaagtcactggtagtcagcgctaataatgccggcgatcagaatgccttcttctggaaccaggataacggggtcatcaacttcgatcacgacagcgccagtgccgtgaaagccacccacagcaactttattgcccagaatgacggcatcatgaacatcagcggcaccggtgctgtggctatggaaggtgataagaacgcgcagctggttaacaatggcaccatcaacctcggtaccgcaggcactactgacacggatatgatcggtatgcaactcaatgccaacgccacggcggatgcggtgatcgagaacaacggcaccatcaatatcttcgctaataactcgtttgcatttagcgtactgggtacagtaggtcatgtggttaacaacggcacggtggtgattgccgatggggttacgggttctggcctgatcaagcagggcgacagcatcaatgttgaaggtatgaacggtaacaacggtaatagcagcgaagtgcattatggcgactatacgttgccggatgtgccgaagcccaatacggttagtgtaacgtcgggaagtgatgaggctggtggcagcatgaacaacctcaacggctatgtcgtcggtaccaacgttaacggcagcgccgggaagctgaaggttaacaatgccagcatgaacggcgtggagattaacacgggctttaccgctggtacggcagacaccattgtgagttttgataacgtagtggaaggtagcaacctgaccgacgctgacgccatcacctcaacgtccgtggtatggactgccaaaggcagcaccgatgccagcggtaacgttgacgtcaccatgagcaaaaacgcttataccgatgtggcaacagatgcctcggtgaatgacatcgcgaaagcactggatgcgggttacaccaacaacgaactgtttaccagcctgaacgtcggcacgactgctgaactgaacagtgctctgaaacaggtcagcggtagccaggcgaccacggtattccgcgaagcgcgcgtgttaagcaaccgctttagtatgctggcagatgccgcgccgaaagtgggtaacggtctggcgttcaacgttgtcgcgaaaggcgatccgcgtgccgagttaggtaataataccgaatacgacatgctggcattgcgtaaaactatcgacctgagcgaaagccagacgatgagtctggagtacggtatcgctcgtctcgatggtgatggtgcgcagaaagcgggtgataatggcgttacaggcggttatagccagttctttggcctgaaacatcagatgtcgttcgataacggcatgaactggaataacgccttgcgttacgacgttcacaaccttgacagcagccgctcgattgcatttggcaacacgaacaaaacggctgataccgacgtgaaacagcagtacctggagttccgcagcgaaggggcgaagactttcgaaccgagcgaaggactgaaggttacgccatatgcgggtgtaaaactgcgtcacacactggaaggtggctatcaggagcgcaatgccggagactttaacctgaatatgaacagtggcagcgaaacggcggtggacagcatcgtcgggctgaaactggactacgcaggtaaagacggctggagcgctagcgctacgctggaaggcgggccgaacctgagctacgcgaagagccagcgtacggcaagcctggcaggcgcaggtagtcagcactttaacgtcgatgacggtcagaagggcggcggcatcaatagcctgacaagcgtcggcgtgaagtacagcagcaaagaaagttcgctgaatctggatgcgtacaactggaaagaggatggcatcagcgataaaggcgtgatgctgaacttcaagaaaacgttctaatttttagcatgtgatccctaaaccgcaacgctgatacaggttgcggtttttttattgccggatgtggtacgtgacgcgttttgttttgtgtctttcaggacaatagagcaactcatccagtaatcttgtttacaccttcgcattatttatctcttttcgtttctatactgatttttcttaatccgttttattacagggcagggtgcgatgagcagcaatacatttactctcggtacaaaatccgttaaccgtcttggttatggcgcgatgcaactggcaggtcctggagtttttggccccccacgagatcgccacgtcgctataaccgtgctgcgtgaggcgctggcattgggcgtcaatcatattgataccagcgacttttatggtccgcacgtcaccaatcagattatccgcgaagcgctttatccttactctgacgacctgacaattgtcactaaaattggtgcgcggcgtggagaggacgcatcctggttgcccgcattttctccggcagagctgcaaaaagcggtgcacgataatctacgtaatctcgggctggacgtgctggatgtggttaacctgcgcgttatgatgggggatggtcatggcccagcggaaggatcgattgaggccagcctgaccgtgctggcagagatgcaacaacaaggcttggtaaaacatattggcctgagcaacgtcacaccgacgcaggttgcagaggcgcgcaagattgccgaaattgtctgtgtgcaaaacgaatacaacatcgcgcaccgtgctgatgatgcaatgattgatgctttggcccacgatggcattgcctacgtgccgttcttcccgctcgggggctttacaccgctgcaatcgtccacactttccgatgttgctgcgagcctgggtgcaacacccatgcaggtggcgctggcgtggctgttacaacgttcaccgaatattttgctgatcccagggacgtcttcggttgcgcatttacgggagaatatggctgctgaaaaattgcatctttctgaggaagtgttgtctacgttggatggtatttcgcgagaataacgaatatacaaaagggaaagatgcatttcccttttgtttcttttttaatggcatggagtgcatatgtttaaggccaggatttgcggctggataggtttacttcccctgtttatgctgagtcttccagtacaggcggaacttcgatgtgttgcaaatacagttgatattgaaccatttttttctgcggctaccgctgaagataaacaacaagttgaacaagctatcaacagtagcgtgaatcttgtccccttcggtttatctgcatcggactggaaagtgcatcgtggcgatttagtggtagaaggtaatatagagagtaatcaaaaattgattgttcttggtaatttgacagtcaaaggtaatatttccactttctctctttctaatccatgggttattctcggtaacgtgacggcaacgaatatagttacggattcaccactgttaattaccggttcgataaatgcaagtggactggtatttatcgactcatattacgataatccgtctacgattaaggggagtattaatgcgcgtgggatatttatcaatgacataattgcacctgttgttgcgtcttcgacaaatagtgaattcatggcccgtgcgagtgacaaaaatgacactgaaaatgtcaaaaaagcgctgatgataataaatcctgatgcatattattggggtctaataaatgatgaagatgctctgaaagaaatttttaagcgaagcaatattcgcatggcagggaatgtctgtaatcagatgaaaaaagaagcgctgtttcgccctaagccttctcctgagttagtgcaggaattgcaaatgctggatgaaggcaacgttgctgcatttgaaggacgagatattgcgacatttgatcttgccataatccgaactctcccaaggcttaaaggaatttcagctaacctacgcaaacaacttattaatagcaatgatgaacaaacgattgaaagtatggcgagatatatgcctgacaatgagattctggagttgaccgatcagcaattgggttaccagcctgttgttctggggttgctcgaccgtgaaccgctctctgtcgaaataatgacgcgaatgagtcgtctacctgatggtgtcggtccgttgaatcttgcgctacgtgaaaatctccctctggatatcgtaatgactctggcgaaaagagattgggatatgatcattcaggagctttataaagatgcgtggttattgcctgaatccattattgatggctatttccgcagtgatgattcctctattcgtcaggtcggtgctggaggacaactcacctacaatcaggcaatgcagttggcgaacgattcatcaaacaatgttgtcacaagcttagcgttcaagctggcagagatgaaacaccatggtcaattattgcggatgacgccacaagagagtgacaaagttgcagcctatttataccaaaaattcgagaatgacgatgatctaatacgtgtgttatttttagcattgccagataacttacagtttaattttgttaaaaggatggagaaaaaatcccctgcctacttttgctgtcgggatatgcaggtaattcactctgacgctgctctacaacggttattgacacgtttcaacgatcctgaggggtggagtaatctggcgaaaaatcagtatctgagcacgtcgatgaaacaaaaaatttggcaacgtgctttatcgcatcggaaaaataatccgaaagcagattcagctgcgtatgaaaccagcgctgatatgattttgtctgagcttatcagccacggtgaagttgatgatcagatgctattaaatgccacagccctgatacgtttggaagactgggactttttagagagtgcattagttagttgggataatttacccgctgttgtcctcaaggaattacagcaaaatacgccacgcaatgatatttgggcgaagttttttctgaggcaggaaaacagctcccgtgcgcaggttgatgaagcattacgcgtctattatgcactcgaccccgatgcgttagcacaactggatgtactggcaaaacaaccggatcgtatatggtggagtacactggcgaaaagcaatctcacatttttcaagttcggcgcacttaacaaccgccacacaccgcctgcagtactggcggcagaaattgatcccgagtggtggattgtggcgatgaataatccccgttttccagttgatgtattaaaggcgaggctgaaacgtgatcctttgctggcgttagagcttgttaaccctgaactggatttagtccgccagctggcgcttaacggtaagacgcgcgcaatacgggaacaagcgatgagaaaacttgatgagttgtattgatccacaacgtaatatttcttaaccctttgattaattggggataattattcctgacagtgagtccccaataccttgatatattctgaatttttaatgaagcggcgtgttgcgatatctccgtcaggggaattgatgcaccatagcgcaaaccgaattatcaaggattgataatgacgctctaccagataaaaccgctctttcagtcgctgttaaggccgacgatgttttggctttacaagcaccacgttacagcgaatcacatcactcttgctgcactggcgctttctcttcttaccggattgctgttgatgttggtggcacaacccatcctctttatgctattgcccatcgtgctttttatccgtatggcgctcaatgcgctggatggcatgttggcgcgtgagtgcaatcagcaaacacggcttggggcaattttgaatgagactggtgatgttatttccgatattgcgctctatttaacatttttatttttaccggaaagtaacgcatcactcgtgatactcatgttattttgcaccatattgaccgagttttgcggtttactcgcgcagacgattaacggtgttcgcagttatgccggtccatttggcaaaagcgatcgcgcgttaatatttggtctgtggggtctggccgttgccatttatccacagtggatgcagtggaataatcttttatggagcattgcttcaattctgcttctctggactgcgattaatcgttgtcggagtgtgcttcttatgagcgctgaaatataatgctggaaaaatctctggcaacacttttcgcgttgttaattttagcaacgctgataaaccgttttctgctatggcggttaccggagagaaaagggggtgaggttacattacgtattcgtacctggtggggcatcgtcatttgtttttcaatggtgatttcaggtccacgctggatgacgttgacgttttttgcgctgataagttttctggcattgaaagaatattgtacgcttatatctgtacattttccgcgttggttatattggggtattcctcttaactatttgcttatcggttttaattgctttgagctgtttctgttatttatacctttggctgggtttctgatattagccaccgggcaagttttagtgggtgacccctctggttttctgcataccgtgagcgccattttttggggctggataatgaccgttttcgccttgagtcatgccgcctggttattaatgttgccaaccacaaatatccagggcggggcgttactggtgttatttcttttggcattaaccgagtcaaacgatattgcacagtatttatggggaaaatcctgcggcagaagaaaagtggtccctaaagtcagcccgggaaaaacattggaaggtctgatgggcggcgtcatcaccatcatgattgcgtcactgattatcggaccgttactgacaccgctaaatacattacaggcattattagcgggtttgttaattggtattagtggtttttgcggcgatgtcgtgatgtcagccatcaaacgagatattggtgttaaagatagcggaaaactattgccaggacatggcggactccttgacaggattgactcattaattttcaccgctccggtatttttttattttatacgctactgctgttactgaaggaaaatagagaaaatggaaaattcacgcatccctggggaacatttttttaccaccagtgataatacagcgttgttttatcggcactggcccgctttacagcccggggcgaaaaaggtcatcgtcttatttcatcgcgggcatgaacattctggtcgtctacaacatctcgttgatgaactggcgatgccagatactgctttttatgcctgggatgcccgagggcatggaaaaagttcggggccgcgtggttatagcccatctcttgcgcgttcagtgcgggatgtcgatgaatttgtccgttttgctgccagcgacagccaggttggactggaagaggtggtagtgatcgcgcaaagcgtcggcgcagtgctggttgccacatggattcatgattatgcacctgcaattcgcgggctggtgctggcttctccggcctttaaggttaaattgtatgtgccgctggcacgtcctgcgctggcgttatggcatcgtctgcgtggtctgttttttattaattcctatgtgaaaggacgctatttgacccacgatcggcaacggggggcgagtttcaataatgatccgctgatcacacgggcgattgccgttaatatcttgctcgatctctacaaaacgtctgaacgtattattagagatgcggcggcgattacgctccccacgcaacttctgatatcaggcgatgactatgtggtgcatcgccaaccgcagattgatttttatcagagattacgtagccctctgaaagagctgcatctgctgccaggcttttatcacgacacgttgggtgaagagaacagggcgctggcatttgaaaaaatgcaaagctttattagtcgtttatatgctaacaaatcgcaaaaatttgattatcagcatgaagactgcacaggaccatcagcggatcgatggcggctactttctggtggacccgtgccattatcgccggttgatttagtgtatcgctttatgcgaaaggcgatgaaattgttcgggacgcactcttcgggcctgcatctcggaatgagcaccggctttgattcaggcagttcgctggattatgtctatcaaaatcaaccgcaaggtagtaacgcattcgggcgcttaatcgacaaaatctacctgaacagtgttggctggcgcggtattcgccagcgcaaaacccatttacaaatactgattaaacaagccgttgccgatctccacgccaaaggtttagccgtccgcgtggttgacattgccgcagggcatgggcgctatgtactggatgcactggcaaacgagcctgccgtaagcgatattttattacgtgattacagtgagttaaatgttgcacaggggcaagagatgattgcccaacggggaatgtctgggcgggtgcgttttgaacagggcgatgcgtttaacccggaggaactcagcgcgttaactccgcggcctacgctggcgattgtctctggactgtatgagctgtttcccgaaaatgagcaggtaaaaaactcactcgcaggtcttgccaatgccatcgaaccgggcggcattctcatctacaccgggcagccgtggcaccctcaactggagatgattgccggggtgttaaccagtcataaagatggtaaaccgtgggtaatgcgcgtgcgttcgcaaggggagatggattcactcgtgcgtgatgccggatttgataaatgcacacaacggattgatgagtggggtatttttacggtttcgatggcggtgcgtcgtgataactgaacgtcggaacgtattgctacaaggcgctggctggttattgttgctggccccgtttttcttcttcacctatggatctcttaatcagttcaccgcggttcaggaccttaacagccatgatattcccagtcaggtattcggttgggaaacggcgatcccttttcttccctggactattgttccttactggagtctggatcttttatatggattttcgctgttcgtttgtagcacgacattcgaacagcgccgacttgtccaccggcttattctggcaacggtaatggcctgctgcggtttttttctctacccgctgaagtttagttttatccgtcctgaagtgagtggggtgacaggatggctattttcgcaacttgaactgtttgatctgccttataaccagtctccttcgctgcatattattctctgctggctactttggcgtcactttcgtcagcatctggctgtgaggtggcgtaaagtctgcggcggatggtttttactcatcgccatttcgacgctgacgacctggcagcatcattttattgatgtcatcacggggctggcggtaggtatgttaattgactggatggtgcccgtcgaccgtcgttggaattatcagaaacctgatcaacgtcgaatcaaaatagcactgccatatgtcgtaggcgcgggctcgtgcattgtgttgatggagctaatgataatgcttcagttatggtggtcagtctggttatgttggccagtattatcgctattcatcattggccgtgggtacggtgggcttggcgcgataacaacagggaaagatagtcaggggaaactcccgcccgccgtttactggctgacattgccctggcgtatcgggatgtggctgtctatgcgttggtcttgtcttcgcctggagccggtgagcaaaattactgctggtgtttatttaggggcgtttccacgacatattccggcacagaatgcggttctggacgtcacctttgaattccctcgcggacgagccacaaaagatcgactctatttttgtgtaccgatgctggatctggtggttccggaagagggggagctccgacaggccgtggcgatgctggaaacattacgcgaagagcaaggcagcgttctggtccattgtgcattgggattatcgcgcagtgcgctggtggtggcggcatggttgttatgttacggacactgtaaaaccgttaatgaagcgattagctatattcgagccagacgcccgcagattgtgctgacagacgagcacaaagcgatgctgagattatgggaaaacaggtaagtggattgagatgtggactgaatatctacagtccacatcaagaccgtgtccggttatgcagaaacaatgctgtcgatggctgcttttgcgtcagactgtgctttcgctgccatttccggaccgtatgcgatcccttcggcgaagacaaatttcacatcggtaatgccgataaagccgaggaacgtggacagatacggcgtcaccaggtccgttggtccatctttgtggatcccgccgcggctggtaataacgatggcttttttacccgttaccagaccttccggaccgttctcggtatagcggaaagtaacgcctgcgcgggcaaccaggtcaaaatagtttttcaactgagtcgagatgttgaagttatacatcggtgccgcaataacgataacgtcgtgggctttcagctcggcaatcaactcatcggaaagtgccagagcttcctgctgacgcggagtcagcggcgcatcgctcggacgcagagcgccaaccagttcgccatccagtaccggaatcggatttgcagccaggtcgcgaacggtgatttcatcagcggagtgcttttcgcgccattgttcaacaaaataatcggacaactgattagactgagagtaccctgccaggatgctggatttaagaactaataccttgctcatggtgtttccttatagatgtttgaatgggcgatgccccgttgcttgttgacactttattcacaatcctgccacagagatagcgcaataaatcgaagcctatgttcgaatttattgaacaacgcatagaaagccgcgatgtggtactctatatctatcatttaaaagaaaattaatcaggcagactactgcccactaacgttatgacagaacaacaaaaattgacctttacggccttgcagcagcggctggattcgctgatgctgcgtgacagactgcgtttttctcgccgtctgcacggcgtgaagaaggttaaaaatcctgatgcacaacaggccattttccaggagatggcgaaagagattgaccaggcggcagggaaagtcctgctgcgtgaagcggcacgaccggaaattacttatcctgacaatttaccggttagtcagaaaaaacaggacattctcgaagcgattcgtgatcaccaggtggtgatcgtcgccggggaaacgggttctggtaaaacgactcagttaccgaaaatctgtatggagctggggcgcgggattaaaggactgatcggccatacccagccgcgtcgtctggcggcaagaacagtggcgaaccgtattgcggaagagctgaaaacggagccgggcggttgcatcggttacaaagtgcgtttcagcgatcacgtaagtgataacacgatggtcaagctgatgaccgacggtatcctgctggcggagatccagcaagaccgcctgctgatgcagtacgacactatcattattgacgaagcgcacgaacgcagcctgaatatcgattttttgctcggctatttgaaagagttgctgccgcggcgtcctgacctaaaaatcattatcacttccgcgactatcgacccggaacgcttttcgcgccactttaataatgcgccgattattgaagtctccggtcggacctatccggtggaagtgcgctatcgcccgattgttgaagaagccgatgacaccgagcgcgatcagttgcaggcgatttttgacgccgtagacgaactgagtcaggaaagccatggcgacattctgatctttatgagcggcgagcgggaaatccgcgataccgccgatgcgctgaacaagctgaacttacgccataccgaaatcttgccgctttatgcgcggctttcgaacagcgaacaaaatagggtattccagtcgcacagcggacggcgcattgtgctggcgaccaacgtcgcggaaacgtcgctgaccgtaccggggattaaatacgttatcgaccccggtacagcgcgtatcagccgctacagctatcgcaccaaagtgcagcgtttgccgattgagccgatttcccaggcgtctgccaatcagcgtaaaggccgctgtggtcgtgtgtccgaagggatctgtattcgtctctattccgaagacgatttcctctcgcgcccggagtttaccgatccggagattctgcgtaccaacctggcctcggttattttgcagatgaccgcgctggggctgggcgatatcgctgcgttcccgtttgtcgaagcaccggataaacgcaatatccaggatggcgtgcgtctgctcgaagagctgggcgcgatcaccactgatgaacaggccagcgcctataaactgacgccgctcggtcgccagctctcgcagttgcctgtcgacccacgtctggcgcgtatggtgctggaagcgcaaaaacatggctgcgtgcgtgaggcgatgattatcacgtccgcgctctccattcaggatccgcgcgaacgtccgatggacaaacagcaggcatcggacgaaaaacatcgtcgcttccacgacaaagagtctgactttctcgcgtttgtgaatctgtggaattatcttggcgagcagcaaaaggcgctttcttccaacgccttccgtcgcctgtgtcgtatcgattatctcaactatctgcgcgtgcgcgaatggcaggatatctacacccagttgcgtcaggtggtgaaagaacttggcattccggttaacagcgaaccggcggagtatcgcgaaattcacattgcgttgctgaccggtttgctttcccatatcggcatgaaagatgccgataaacaagaatataccggcgcacgtaacgcgcgtttctccatcttccccggttctggtttattcaaaaaaccgcctaaatgggtaatggtggcggaactggtagaaaccagccgcctgtgggggcgcattgctgcgcgtatcgacccggaatgggtggagccagttgctcagcatttgattaaacgcacctacagcgaaccgcactgggaacgggcgcagggcgcggtgatggcaacggaaaaagtcactgtttatggtttgccgattgttgctgcgcgtaaggtcaactacagccagatcgatccggtgttatgtcgtgaactctttattcgccacgctctggtggaaggtgactggcagacgcgtcacgcattcttccgtgaaaacctgaaactgcgggccgaagtggaagagctggaacacaaatcacgtcgccgcgatattctggttgatgacgaaacgctgtttgagttctacgaccagcgcatcagccacgatgtaatctccgctcgtcacttcgatagctggtggaaaaaagtcagccgcgaaacgcctgatttgctcaactttgaaaagagcatgttgatcaaagaaggggcggaaaaaatcagcaagctggattacccgaacttctggcatcagggcaatctcaagctgcgtttgagctatcagtttgagccaggcgcagacgcggacggtgtgaccgtacatattccgctgccgttacttaaccaggttgaggaaagcgggtttgaatggcagatccccggtctgcgccgcgaattggtgattgctctgattaaatcgttgccgaaaccggtacgccgtaattttgtgcctgcaccaaactacgccgaagcgtttttaggccgcgtcacaccgctggagttaccgttgctcgacagccttgagcgcgagttacggcggatgaccggcgttaccgttgaccgcgaagactggcactgggatcaggtgcccgatcacctgaaaatcaccttccgcgtggtggatgacaaaaacaagaagctaaaagaagggcgctcgctacaagatctgaaagatgcgctgaaaggcaaagtgcaggaaacgctgtctgcggtggcggatgacggtatcgagcagagcgggctgcatatctggagttttggtcagctgccggaaagctacgaacagaagcgtggcaactacaaagtgaaggcgtggccagcgctagtggatgaacgcgacagtgtggcgatcaaactgtttgataatccgctagagcaaaaacaggcaatgtggaacggtcttcgccgtctactgctgctgaatattccctcgccgatcaagtatttacatgagaagttaccaaacaaagccaagctggggctgtactttaacccgtatggcaaagtgctggagctgatcgacgactgtatctcctgcggtgtggataaattgatcgacgccaatggtggcccggtctggacggaagaaggctttgctgcgctgcatgaaaaagtgcgtgccgaactgaacgacacggtggtggatattgcgaagcaggtcgagcaaatccttacggcagtgttcaatatcaacaaacgtctgaaagggcgggtggatatgaccatggcgctggggctttctgacattaaagcgcagatgggcgggttggtatatcgcggttttgtcactggtaacggcttcaaacggctgggcgacacgctgcgatatttgcaggcgattgaaaaacgactggaaaaactggcggttgatccacatcgcgaccgtgctcagatgctgaaagtcgaaaacgtccagcaggcgtggcagcaatggatcaacaaactgccgcctgcacgtcgtgaggatgaagacgtgaaagagatccgttggatgatagaagagctgcgcgttagttacttcgctcaacaacttggtacgccttatccgatttcagataagcgtattttgcaggcgatggagcagattagcggttaaccctgctatttgcctgataaatctaaaacccggtaagcatttagcgccgggttttttattaattctaaaacggtaaggacaaaaattcaggaattcagaaaaatacaattctcagctgcaagatgaataatgtttatctacagcatttccttaaaagatatgtcaggcttgcggagtggcggttaaggaaatacgacttcctcctttcagagtgctccgcttctcactattatctcacgcagtattcttaagggaacgataaggaggaaccatgaacattaccccgtttccgacgctttcgacggcaactatagatgccataaatgttatcggacagtggctggcgcaggatgatttctccggtgaggtgccgtatcaggctgattgcgtcatacttgcaggaaatgcggttatgccgactatcgatgcggcatgtaagattgctcgcgatcagcaaattcctttactgattagtggtggtatcggtcactcgacaacttttttgtatagcgccatcgcacagcatccgcactacaacactatccgcaccactggcagagcagaagcgaccatcctggcggatatcgctcatcagttctggcacattccgcatgaaaaaatctggattgaagaccagtcaacaaactgcggtgaaaacgcacgctttagcatcgcgctattgaatcaggccgtagaacgagttcatacggctatcgttgttcaggaccccaccatgcagcggcgcacgatggcgacgttccgccgtatgactggggacaatcccgatgcaccacgctggttaagttatcccggattcgttcctcagttaggaaataacgcagacagtgtaatctttgttaacccgttgcaaggattatggccggttgagcgttatctatcactactcactggcgagctgccgcgtttacgcgatgatagcgatggctacggtccccgcgggcgagattttatcgttcacgttgattttccggcagaagtcatccatgcatggcaaacgctgaaacacgatgcggtgcttatcgaggcgatggaaagtcgctcgttacgttaaaaattgcccgtttgtgaaccacttgtttgcaaacgggcatgactcctgacttttatttctgccttttattccttttacacttgtttttatgaagcccttcacagaattgtcctttcacgatgccgtctctctgatgattgatgttaattaacaatgtatttaccgaaaacaaacatataaatcacaggagtcgcccatgtcagtacccgttcaacatcctatgtatatcgatggacagtttgttacctggcgtggagacgcatggattgatgtggtaaaccctgctacagaggctgtcatttcccgcatacccgatggtcaggccgaggatgcccgtaaggcaatcgatgcagcagaacatgcacaaccagaatgggaagcgttgcctgctattgaacgcgccagttggttgcgcaaaatctccgccgggatccgcgaacgcgccagtgaaatcagtgcgctgattgttgaagaagggggcaagatccagcagctggctgaagtcgaagtggcttttactgccgactatatcgattacatggcggagtgggcacggcgttacgagggcgagattattcaaagcgatcgtccaggagaaaatattcttctgtttaaacgtgcgcttggtgtgactaccggcattctgccgtggaacttcccgttcttcctcattgcccgcaaaatggctcccgctcttttgactggtaataccatcgtcattaaacccagtgaatttacgccaaacaatgcgattgcattcgccaaaatcgtcgatgaaataggccttccgcgcggcgtgtttaaccttgtactggggcgtggtgaaaccgttgggcaagaactggcgggtaacccaaaggtcgcaatggtcagtatgacaggcagcgtctctgcaggtgagaagattatggcgactgcggcgaaaaacatcaccaaagtgtgcctggaattgggtggtaaagcaccagctatcgtaatggacgatgccgatcttgaactggcagtcaaagccatcgttgattcacgcgtcattaatagtgggcaagtgtgtaactgtgcagaacgtgtttatgtacagaaaggcatttatgatcagttcgtcaatcggctgggtgaagcgatgcaggcggttcaatttggtaaccccgctgaacgcaacgacattgcgatggggccgttgattaacgccgcggcgctggaaagggtcgagcaaaaagtggcgcgcgcagtagaagaaggggcgagagtggcgttgggtggcaaagcagtagacgggaaaggatattattatccgccgacattgctgctggatgttcgccaggaaatgtcgattatgcatgaggaaacctttggcccggttctgccggtggtcgcatttgacacgctggaagatgctatctcaatggctaatgacagtgattacggcctgacctcatcaatctatacccaaaatctgaacgtcgcgatgaaagccattaaagggctgaagtttggtgaaacttacatcaaccgtgaaaacttcgaagctatgcaaggcttccacgccggatggcgtaaatccggtattggcggcgcagatggtaaacatggcttgcatgaatatctgcagacccaggtggtttatttacagtcttaatgagtgaaagaggcggaggttttttcctccgcctgtgcgcgtcagagtttagcgaatttttcgagggtgcgaataagctgtgtgacgaagccatattcgttatcgtaccaggcgaccgttttcaccagttgtaaatcgcccacggcggtaatttccgtttgcgtggcatcaaacaccgaaccgaaatggctgccaatgatatcggaagagactatttcttcatcggtataaccaaatgactcgttattggtggttgcttgtttaagtgcgttattcacctcttcggcagtcactttttttccgagaatcgataccagttcagtgaccgaacctgttttcaccggcacgcgttgcgcatgacctttcagtttgccgctcagttccgggatcaccagaccaatggcttttgccgcccccgtagtgtggggaatgatattttctgccgctgcgcgtgaagcacgtaaatctttaccacgcgggccatccaccagtgactgggtgccagtataggcatgaatggtcgtcatcgtgccgacttctatcccgaaactgtcatgcaaggctttggccatcggcgcaagacagttagtggtgcatgacgccacggaaacaatggtgtcgttgccatccagagtgtcgtcattgacgttataaacgatagttttcatttcaccggcaggggcggaaatcaacaccttcttcgcaccagcatcaagatgcgcctgcgatttctcggcggaggtataaaagccagtacattcgacaatgatttctgcacctttcgctttccacggaatatttttagcctctttttcggcgtaaaccgcgatacttttcccatcaacgataagtgaatcttccgtaaaatcaacgctccaggggaatggtccgtagtttgaatcatgtttcagcaggtaggcgagaatttttggggaagtgagatcattaatagcgacaacgtctatgttgcttttgacttcaagtaatcgacgcaacaccagtcgaccgatacgaccaaaaccgttaataccaactttactcatggttttctcctgtcaggaacgttcggatgaaaattgatcctttccaggcttagaccaggatggcgggatgggcaatctccattctcacagtgaaacgtaacgtactgaaaacgggtgaacaatatttaatgaaattttgagaaaagcccgttatgttaacggaaaattatgttaaagcaggaaatgttatggaaaataaatattcaaggttacaaatcagcattcactggctggtctttttactggttatcgcagcgtattgcgcaatggagtttcgtggtttcttcccacgtagcgatcggccactcatcaacatgattcatgtttcctgtggcatctcaattctcgtgctgatggtcgttcgtcttttgttaaggctgaaatacccaaccccgccgattatacctaagccaaaaccgatgatgacgggactggcgcatttgggacatttggtgatttatctcctgtttattgcgctgccagtgattggtttggtgatgatgtataaccggggcaacccgtggtttgcgtttggtttgacgatgccttacgcttcagaggccaatttcgaacgggtagatagcttaaagtcgtggcatgaaacgctggcgaatctgggatattttgtcatcgggttgcacgctgcggctgcactggcacaccactatttctggaaggacaacacacttctacgcatgatgccgcgtaaacgttcctgaagggtatttaaagaaaacgcctgtactaaaaccgacccgtggtacaggcgaagaatacgggtctacatcggaagcgcctattatatttatttgtatgacaaataaaaccataatccttgcccatacgtccatctggcttatttttaatcaattcacccgatctttgatctcatcaacggtatcaaaataaaccagcgtataacgttcaaatcgaacataagattcgataaaccatggaggttatatgaaaaaactggcacttattttgtttatgggaacgcttgtttccttttatgccgatgccgggcgcaaaccctgttctggttcgaaaggggggatctcacactgtacggcaggcggcaaatttgtctgtaatgatggttctattagtgcatcgaaaaaaacatgcactaactgaagtgtaaaaggggtgccatgagataatgaatctgctagtcagatgcgcggggaaaatccccgcgcttgcccttacctggacgtgcaggccatgagcgcagcaacctccttatcaccgtcccggaaccgcagttcgtagagcgtttgtcgggtcaggagtgtgaatgtcagaatcgtaatgcagataatgagcagacacaccaccagagggttgcgtttcatagcctttctccttgccggatggcgggtaagaggctaagatctgaattgctatgttcattcgttggcctcggttgatagaaatatcggtcggggccttcgtctttctgattcccggttagcctgaaaacagaaagtctcaggcacccgcaggcatcctatgaggtttccttagggacgaaaataatcacttcacgaaattgcgtgctgttttccagaatttttcgtcattcgggttagcccgtttaatcattcgttactctcttcattccaatggcattaaccttctctgcaataattgttgtaaaaatgtgacgcaaagaggcttttagtcgtaagtaattaccgtcaagtgccgatgactttctatcaggagtaaacctggacgagagacaacggtaatgaatacaactccctcacagcgattaggttttttgcatcacatcaggctggttccgttatttgcctgcattcttggcggtatcttagttctattcgcattaagttctgctctggctggctatttcctctggcaggccgatcgcgatcagcgtgatgttactgcggagattgagattcgaaccgggttagcgaacagttcagattttttgcgttcagcccggatcaatatgattcaggccggggctgcgagtcgtattgcggaaatggaagcaatgaagcgaaatattgcgcaagccgaatcggagattaaacagtcgcagcaaggttatcgtgcttatcagaatcgaccggtgaaaacacctgctgatgaagccctcgacactgaattaaatcaacgctttcaggcttatatcacgggtatgcaacctatgttgaaatatgccaaaaatggcatgtttgaagcgattatcaatcatgaaagtgagcagatccgaccgctggataatgcttataccgatattttgaacaaagccgttaagatacgtagcaccagagccaaccaactggcggaactggcccatcagcgcacccgcctgggtgggatgttcatgattggcgcgtttgtgcttgccctggtcatgacgctgataacatttatggtgctacgtcggatcgtcattcgtccactgcaacatgccgcacaacggattgaaaaaatcgctagtggcgatctgacgatgaagaatgaaccggcgggtcgtaatgaaatcggtcgcttaagtcgtcatttacagcaaatgcagcattcactggggatgacagtagggactgttcgacagggtgcggaagagatttatcgtggcaccagcgaaatttcagctggcaatgcggacctgtcatctcgcaccgaagaacaagcggcggctatcgaacaaactgccgctagcatggagcaactcactgcgacggtgaaacagaatgcggataacgcgcatcatgccagcaaactggcgcaagaggcttctattaaagccagcgatggcgggcagacggtttccggtgtagtaaaaacgatgggcgctatctctacaagttcgaagaaaatttccgagatcaccgccgtcatcaacagtattgctttccagacgaatattctggcactgaatgctgccgttgaagccgcgcgagcgggtgagcaaggccgtggatttgccgttgtcgccagcgaagtacggacactcgcaagccgcagcgcccaagcggcgaaagagattgaaggcttgatcagtgaatcagtcaggttaattgacctggggtcggatgaggtggcaacggcagggaaaaccatgagcactattgttgatgccgtcgcgagtgtcacacatatcatgcaggaaatcgccgccgcctcggatgaacaaagtagaggcataacgcaggttagccaggcgatttctgaaatagataaggtgacgcaacagaatgcttctctggtagaagaggcctcagcggcggcgttgtcccttgaagaacaggcggcacgattaactgaggcggtggatgtattccgtctgcacaaacattctgtgtcggcaaaacctcgcggagcgggtgaaccagttagtttcgctacggtgtgaaaatgttcaaggagggatcgacagatcccttcacctttcagaacggcattgattttcgaatagcgttaatcatcaactggcaaccagaagagaacgtcgcatctacgcgggtcagtattccaatcggttcgcctgcaccatgtcccggaacaggcagggccaccagcgtggcatgacgcaggtcgtcttttaccgcgccagaagggacaaaccacacgtagtcgtattcaaccgtaagttgacgagatagcgaagcagacagcgtttcgatacaacccgaaggaattttacatccctggctctgtactaatgcatctgaatgctggcgtggcgcagtgccttctggtgatacaacgaccggccattccagcacccggcttagcgttacgttctcctgaagtagcgggtgattagggcggacaaccagcttcagcgattcaagaaacagcagttcgtaattaagcccggtcatcagttcaggatctgacatccgaccaatgccgatatcgatttccccggttttcaaacccgccagaatcatagggttactcattgtcgcaacttgcaaggtcgtttctttttgttgctgatgaaactgacctataaccgaaggtaatatccccagtgccgcagtaggtagtgcaccaaccctgacgacatcattattaagaccttctttacgatgaagcgactgtccggcagtgttgatggcgtcaagaactctgactgcatgcgttaaaaattgttcgccgggtaaggtaagttgcgccccctgacgaccacgctcaaacaagcgagcgcccgtcagctgctccagttcattcaatgtcttagagagcgcaggttgactcaaattaagggtttcagccgcgcgccccaaagttccttgttgtgcgacagctacgaatgtatgaaggtggcgcaaacggatgcgctgactaaacagactatttttttccataagcgatgttaaaaacgaagcggtgtcgctgacaagtgaagttgtttgattatgataacttgattgcaaaatattattaacaattaaagcaatcatgttacagcaaaatggataatattgatgttttcgcggcgagatcacagtttgtaaattcttcccgccagagtgaatgcggttacctacactccagattactgaccactggaggcagacaatatggcgaacagcatcacggcggatgagattcgggaacagttttcgcaggcaatgtcagccatgtaccagcaagaagttccgcagtacggcacgctgctggaactggtagctgatgtgaatctggctgtgctggaaaacaatcctcaactgcacgaaaaaatggtaaatgcagacgagctggcgcgactgaatgttgaacgtcatggggcgattcgcgttgggactgcacaagagcttgctactcttcggcggatgtttgccattatggggatgtacccggtgagctattacgatctctcgcaggcgggggtgccggtacattcgacagcatttcggcccattgatgatgcttctctggcgcgtaatcccttccgcgtttttacctcgttactccgccttgagcttatcgagaacgaaattttgcgccagaaagcggcggagattctacgtcagcgcgatatcttcaccccacgttgtcgactactgttagaggaatatgagcagcggggcggttttaacgaaacacaggcacaggagtttgtgcaggaagccctggaaacgtttcgctggcaccagtcagcaacggtagatgaagaaacctatcgcgccttgcacaacgaacatcggttgattgctgatgtggtctgttttcctggatgccatatcaaccatctgacgccacgtacgctggatattgaccgggtgcagtcgatgatgcctgaatgcggaattgaaccaaaaattctgatcgaagggccgccgcgccgcgaggtaccgattttactacgccagaccagctttaaagcactggaagagacggtgttgtttgcggggcagaaacagggcacgcatactgcgcgctttggtgaaattgagcagcgtggcgtggcattaacgccgaaagggcgacaactgtatgatgatcttctgcgtaacgctggaaccgggcaggataatctcactcaccaaatgcatttacaggaaaccttccgcacttttcctgacagtgagtttttaatgcgtcagcaagggctggcatggttccggtaccgtctgacgccttcgggtgaggcgcatcgtcaggcgattcatcccggagacgatccacagcccttaattgaacgtggttgggtcgcggcgcaacccattacctatgaagatttcttgcccgttagcgcggcggggatcttccagtcaaatctgggtaatgaaacgcaggcacgcaatcacggtaatgccagtcgcgaagcatttgagcaggcgttgggttgtccggttttggatgagttccagctttatcaggaagcggaagaacgcagtaaacgtcgctgtggtttgctttaaattctgaccatccgcctttgcaaaaatttgcctgattttacaaacgaatcaggctcatcccatcgacataaaaaaaatgccgatttatgcatattctctcagttcaacaattggattattaataaatattgtctagagtgagcggtcataaataagcactttcttgccgctgaaaacgaccagcgcgggaccattcacaacaccagaaggactcactttcaggtatggatcgtagacgatttattaaaggttcaatggctatggccgccgtgtgcggtaccagcggcattgcttctcttttttctcaggcggcattcgcggcagattctgatattgccgacgggcaaacccagcgttttgacttctccattctacagtcaatggcgcacgacttagcgcaaacagcgtggcatggtgcgcctcgtccgttacctgacacgctggcgacaatgacgccgcaggcttataacagtattcaatacgacgccgaaaaatcgctctggcataacgttgagaaccgtcaactggacgctcagttcttccatatgggaatgggattccgtcgccgcgttcgtatgttttctgtagatccagcaacacatctggcgcgtgaaattcactttcgcccggagttgttcaaatacaacgatgcaggtgttgataccaaacaattagaagggcaaagcgatctcggctttgccggttttcgcgtgtttaaagcccccgaactggcgcgccgtgatgtagtatcatttctcggcgcgagttatttccgcgccgttgatgatacatatcaatacggtttgtcggcccgcggcctggcgatcgacacttacaccgacagtaaagaagagttccccgactttaccgccttctggtttgatacggtaaaaccgggggcaactacctttaccgtttatgcgttgctcgatagcgccagcattactggtgcctataagttcactatccattgtgagaaaagtcaggtgattatggatgtggaaaatcacctgtatgcgcgcaaagacattaaacagctgggcattgcgccgatgaccagtatgttcagctgcggtactaatgaacgtcggatgtgcgatacaattcatccgcaaattcatgactctgatcgtctgtccatgtggcggggcaacggcgagtggatttgccgtccgctgaataatccgcaaaaattgcagttcaatgcttacaccgacaacaacccgaaagggtttggtttattgcaactggatcgtgacttctcccattatcaggacattatgggctggtataacaaacgcccaagtctgtgggtggaaccgcgtaacaagtggggtaagggcaccatcggcctgatggaaatcccaacaacgggcgaaacgctggataacattgtctgcttctggcagccagaaaaagctgtaaaagcaggtgatgagtttgcattccagtatcgtctgtactggagtgcgcaaccgcctgttcattgcccattagcgcgcgttatggcgacgcgtaccggcatgggcggtttcccggaaggttgggcgccaggtgaacactatcccgaaaaatgggcgcgtcgttttgccgtcgatttcgttggtggtgatctgaaagctgccgcgccaaaaggcattgagccggtgattacgctgtccagtggggaagcgaagcaaatcgaaattctctatattgaacccattgatggttatcgtattcagtttgactggtatccgacgtcggactccactgatccggtcgatatgcggatgtatctgcgttgtcagggggacgctatcagtgaaacatggctgtatcagtatttcccgccagcgccggataaacgtcagtatgttgacgaccgcgtgatgagttaattgttttttcttcggcaccttcttcgggaggtgccgtctggttaaacacgatcccgctcgcatttttccctaagttaaatgagtaatctgatggtgtgtatttcagatacaccttgtcagccactaacagggagtgcgtatgtttccagaataccgagatttaatatcccgtctgaaaaacgaaaatcctcgctttatgtccttgttcgataaacacaataaacttgatcatgaaattgccagaaaggaaggttccgacggtcgagggtacaatgcggaagtggtccgcatgaaaaaacaaaagctacagttaaaagatgagatgctcaaaatcctgcagcaggagagcgtcaaagaggtgtaaactttcctaagccgccagccaggcggcttttttaacaacagcatggattgactggagataagatgactgaaacgataaaagtaagcgaatcacttgaattacatgctgttgcggaaagtcacgtcacacctctttatcagttaatctgtaaaaataaaacctggttacagcagtcgctaaactggccgcagttcgttcagagtgaagaggacacgcgaaaaacggtgcagggtaatgtgatgttgcatcaacgcggctatgccaaaatgttcatgattttcaaagaagatgaacttatcggcgttatctcgtttaatcgtattgaaccactgaataaaactgctgaaatcggctactggctggacgaatctcatcaggggcaggggatcatttctcaggcgctgcaggcattgattcatcattacgctcagtctggtgaacttagacgcttcgtgatcaaatgtcgggtggacaatccgcaaagcaaccaggtcgctttgcgcaatggttttatccttgaaggttgcctgaaacaggctgagttcctgaatgatgcctatgatgatgtgaacttatacgcgcgtattatcggttcataataaccctgccagcggcgttcgcgtaatgcgctcctcgccgttaatgacttttggaccacggacatgaaccgtgtcgccatcaaaggcttcaacgacggcgtggtcggttaactccacatggttttcaattatcaccgcacctgaaatacggctctcaccttgtattacaacgtgctcgtcgagcagaatcggtccaccacgtaccacggcatttccgccaatcaagacatgatgttttaacacacaattaccttccacaatggcatattccgccacctgcgaactgtaatgaatcgtcggaatggcatcttcttctatgccagctttcacctgcgcgtgaccgtagactttagcgcaatcgcatagccagacgttgttctcttcattaccttcaatactggcaaaatcaaaaacttcggcgcgatgttcaataaaagcataccggatgacggcatcgccataaatttgtgcctggtggacaatacgcgaggcgctaacccttgcgcgatcataaatttgtagcaggagttgatggtcaggcgttaagccttgtgctgcgacgatcatagaatgttgattaattaaggcgtgaccaaatattctacattgcccgcaaaccagtgagtcatgaatggtgacactgtcacttatatatgcaccctggctgatttcactattatcgatccagacattatccgttgcgtaaacctctccccacagtacgctggtgccggtgatgcgcgtattaccggaaatcaccgttccgccgaacgcaatagcattctggtcgtaaatccagcaatttccttcctgtgctaacaccgtttcgcgatcgatccagccgccagcggttcctgctatcacatcgttaaaatcgctaatggcgataatctgccgtaataacacattttttttagtgccatcttcctgataactaaaggctcgctgttcttcacttagacgatatttgcgcatagcgttttcccacaggtgacttactataaccgtagcaaattctgcggctctggctatgctcgagaaaattccataaaatgcatttcaaatatactttataaattaaacaaaatgagtaagaagatgcagagcgataaagtgctcaatttgccggcaggctactttggtattgtgttggggacgatagggatgggatttgcctggcgctatgccagccaggtttggcaggtcagccactggttaggggatgggctggtgattctggcgatgatcatctggggattattgactagcgcatttattgcccgactcatacgctttccgcatagcgtgctggcggaagttcgccatccagtgctgagcagttttgtgagtttgtttccggcaacgacgatgctggtggcgattggttttgttccgtggtttcgcccactggcggtgtgcctgttcagctttggtgtcgtggttcagttggcttatgccgcctggcaaactgcgggattatggcgcggatctcaccctgaagaagctaccacgcctggactgtatctgccgacagttgccaacaactttatcagcgcaatggcctgtggtgcgttgggctacaccgacgccggtctggtgtttttaggcgcaggcgttttctcatggctaagccttgaaccggtgatcttgcagcgtctgcgtagttcgggagaattacccacggcactgcggacatcactcggcattcagctcgctcctgcgctggtggcctgtagtgcctggctgagcgtcaacggcggcgagggtgacacgctggcgaaaatgcttttcggttatggactgctgcaactgctgtttatgctacgtctgatgccatggtatctctcccagccatttaatgcttcattctggagtttctcgttcggcgtatctgcactggcaaccaccggtttgcatctggggagtggcagcgataatggatttttccatacgctggcggtgccgctgtttatctttaccaattttattattgcaatactgctcatccgtacttttgcgcttctgatgcagggaaaattgttagtcagaaccgagcgcgccgttttaatgaaagcagaggacgaagaatgatcattcgtgacgaaaactattttactgataaatatgaattaacccgcacacactctgaagtaatggaagcggtgaaagtggttaaaccgggtaaaacgctggatctgggctgtggcaatggtcgtaacagtctttacctggcagccaatggttatgatgttgacgcatgggataaaaatgccatgagtatcgccaacgtcgagcgcattaaatctattgaaaatctggataatttacacactcgggtcgttgatctgaataacctcacatttgctggacagtacgattttattctttcgactgtggtgctgatgttccttgaggctaaaaccatcccagggctgattgccaatatgcaacgttgcacgaaacctggcggttacaacctgattgtggcggcgatggatagcgctgattatccatgtaccgtcggcttcccgtttgccttcaaagagagagaattacgtcgatattacgaaggctgggagatggtgaaatacaatgaagacgtcggcgagctgcaccgcaccgacgccaacggtaatcgtattaaactgcgtttcgccacgatgctggcacgtaaaaaatgacccggtaagaacaaagcgcgtgaaaattccccacgctgagatagtttactgttcttcttttcggtaagcatattttttatcgaagggatgtgaaattaatcacagtagtcgaagttttttagcagcttaacttactgaaatttaactactgatgattgacttagcccctttttcggcattgactatgtcgtctgaaaaggggctgaaaaatttattttcaccaacactttttttgccacaacacgaagcggcgctttttgctataacttagaaagtaatataatcatctcaggaaactattcatgcgtaccacatcatttgcgaaagttgcagctttatgcggcttattggctctgtctggttgtgcctctaaaatcacccagccagataaatattctggttttttaaacaattactctgatttaaaagaaacaacctcggctacaggtaaacctgttttacgttgggtagacccgagttttgatcaaagcaaatatgacagcatcgtctggaacccaatcacttattatccggtaccgaaaccgtcgacccaggtagggcagaaagttctggataaaattttgaactataccaacaccgaaatgaaagaagcgatagcgcagcgtaaaccactggttaccaccgctgggccgcgtagtctgattttccgtggggccattaccggtgtagataccagcaaagaagggctgcaattctatgaagtggttcctgttgcattagtggttgcggggacgcaaatggctacaggccaccgtaccatggatactcgcctctattttgaaggtgagctgattgatgcagcgactaataaaccggttatcaaagtcgttcgtcagggcgaaggtaaagacctgaataacgaaagtacgccaatggctttcgaaaatattaaacaagttattgatgacatggcgaccgatgccaccatgtttgacgttaacaaaaagtagttccagacgcgccatcgttagatggcgctttttatccggtgcgccgtaaaaccccatccttcagggcggggatataaggcgcggttttccacctgaccaggtgtttgctgttgttcaatgtattggcggatgacggatattggcgcacctccgcagctactggcaaaatagccaggactccacaaaacgcctttgtagtaatacctgactgcaatatctggtcgatctcgtcgcagtcacctacccgatacgcctttgaggctgtttaccagactggatatcgccagtttgggaggatagttaattaacaaatggacgtgatctggttcgccatccatttcaaccagttcagcttcaaaatcagcacatacatttgaaaagtaagtgcgtagtttttctgtcgcgtcatggtcaaaaatctggcgtcggtatctggtgacaaagaccaggtgaacatgcatcaggaaaacacaatgccttccacgccggatatcggtttcttttttcacagaccaaagtatcatttgacctgtgaaacgattacaggcatttaaattccagttaagaccaggtggtcaacaggagtgtgaaatgaggcgcttcgcaggcgcatgtcgtttcgttttcaatcgtgctctggcacgtcagaatgagaatcatgaggccggtaataaatacatcccttacgggaaaatggcttcctggctggttgagtggaaaaatgccactgaaacgcaatggcttaaacattctccctcacagccattgcaacagtcactgaaagaccttgagcgggcttacaaaaacttcttccggaagcgggctgcttttccccgattcaaaaagcggggacagaatgatgcattccgctacccgcagggcgttaagctcgatcaggaaaacagccgtatttttctgccgaaactgggctggatgcgctaccggaacagccgtcaggtcacgggtgttgtgaaaaatgtcactgtcagccagtcctgcggtaagtggtacatcagtattcagacagaaagtgaagtatcaactccggttcacccttcagcatcaatggtcgggctggatgctggcgtggctaaactcgccacgctgtcagatggcacagtctttgagcctgtaaacagttttcagaaaaaccagaagaagctggcgagacttcagcgacagttaagccgcaaggtcaaattcagcaacaactggcaaaagcagaaacgcaaaatacagcgacagcattcctgtatcgcaaatatccgcagggactaccttcacaaagtcacaacggccgtcagcaaaaaccacgcaatgatagtcattgaggatttgaaggtcagcaacatgtcaaagtcagcagcgggtacggtcagccagccggggcgcaatgtccgggcaaaatcaggtttaaaccgttcgatactggatcagggctggtatgaaatgcgccgccagcttgcgtacaagcagctctggcgtggcggtcaggtgcttgctgttccgccagcgtatacaagccagcgttgcgcgtactgtggtcatacagcgaaagagaaccgcctgtcacaaagtaaattcagatgccaggtatgtggatatacagcgaacgccgatgtaaatggcgctcgcaacattttagcggcggggcacgccgttcttgcctgtggagagatggtgcagtcaggccgcccgttgaagcaggaacccaccgaaatgattcaggcgacagcctgaacgtagcagggatccacgtccttcagggcgtggaggatgtcaatatcggtttctgtcagcgattaaattcaacaccacgtaacaaacgcctccggcaattaatccccaaaacgcagaaccaatcccgaccagcgtcaatccacttgccgttatcagaaatgccaccaccgccgcgtctcgctcacgctcattatgcagcgcctgatacaaactgccgccgatggtacttaacagcgccagacctgccagcatctggatccaacttacgggcagggcagccatcatcccggtaatggcactaccaaacagacctgcgagcaaatagaaaatgcctgcaacggcagcggccagccaacgttgatctttatccggatgcgcttccgggctttggcaaatagccgcggtgattgccgcaataccgacggaataaacgccgaaaggggaaaaaaccagtgccagcaatccagtaaatacaattaatggcgaaacaggagccgaatatccagctgctttcattgctgcgatacccggtgcgttttgcgatgccatcgtcaccagaaaaagggggagtgcaacgctcaggctgtgagcaaacgaaaaatcaggggtaatataagtggggagaacgggtttaaagacaacatcagttgtgacaacgtcaccttgcgcgatgacgatcacgatcccaataatcatcgcggcaattaccgcatagcgcggcgcaacggccttggttgccagccataccagcaacatacttccacacaacgtaaattgaccgtccagactggcaaacgcctgtaaaccaaagcgtaataaaatcccggcaagcattgccgccgcaagcgagtgcggaataatgcgcatcagacgagcaaagagtcccgttatgccgcagaggactattagcgcgttggtgacaataaaaacgccgatggcttcgttaagtgttagtccctgcaatccggtgaccaacaaagccgcgccaggcgttgaccatgcggtgagaacaggtacgcgataccataatgtcagagtcagcgtactgacgcccattgccagccccagcgccgtcatccagccagagatttgtgcagtggtggctccggcgacaatcgctgcttgccagattattgccgctgaactggcgtagccaattaataccgccagaaaccccgccagtagcgtgggtggaggaatagaaaacagacgcatagtcacctcgtgcgttatagcgtacaggcaccgtagcatttgtccgttataacgcacaagtgataaacttccgttttgccggaggagtcgcatggaaaatctcgctcgctttttatccaccacacttaaacaactacgccagcagcgcggctggagtctttcgcgactggcagaagcgacgggcgtttctaaagcaatgttagggcagattgagcgtaatgagtccagtccgacggtcgcgacattatggaaaattgccaccgggttgaacgtaccattttcaacatttatttctccgccgcagtccgctacgccttcagtttatgatccacaacagcaggcgatggtgatcacttcgctgtttccttatgatccacaactctgctttgaacacttctcgattcagatggcatctggtgcaataagcgaatcgacgccccatgagaagggggtaatcgaacatgtcgtcgtcattgatggacaacttgatctgtgcgttgatggggaatggcagacccttaattgtggggaaggcgttcgatttgctgcagacgtcacgcatatctatcgtaatggtggggagcaaaccgtacattttcattccctcatccattacccgcgcagttaagcgggaaaactatttcgcaacgtcgcgcttgtggctaaaatagccgccatttttcagctactggataagaatgtgaccgtatcttctcatcgacttgaactgttaagcccggcacgcgatgccgccattgcccgcgaagctattttgcacggtgccgatgctgtttatatcggcggccctggttttggtgcccgtcataatgccagtaatagcttgaaagatattgccgagctggtgccgtttgcccatcgttatggtgcaaaaattttcgtcacgcttaacaccattttgcatgatgatgagctggaacccgcgcaacggctgattactgacctctaccagaccggtgtcgatgcgctgattgttcaggatatggggattctggaacttgatattccgccgattgaactgcacgccagtacgcagtgcgacattcgtacagttgaaaaagcgaagttcctctctgatgttggcttcacgcagattgtgctggcgcgagagctgaatcttgatcagatccgcgcgattcaccaggctacggacgcgaccattgaattctttattcatggggcactgtgcgtggcctattcgggtcagtgctacatttctcatgcgcaaacagggcgtagcgccaaccgtggcgattgctcgcaggcgtgccgtttgccatacacattgaaagacgatcaggggcgggtggtttcctatgaaaaacatctgctgtcgatgaaagataacgatcagactgccaacctcggcgcgctgattgatgctggtgtacgctccttcaagattgaagggcgttacaaagatatgagctacgtgaagaatatcaccgcccattatcgccagatgcttgatgccattattgaagaacgtggcgatctggcgcgcgcttcatcaggtcgtactgaacatttctttgttccatcgacggaaaagactttccaccgtggtagcacagattattttgtgaatgcccgtaaaggcgatattggcgcgttcgattcgccgaaatttatcggcctgccggtaggcgaagtattgaaagtggcgaaagatcatctcgatgttgccgttaccgagccactggcaaatggcgatggcctgaacgtgttgattaaacgtgaagtcgtcggttttcgtgccaatacggtcgagaaaaccggagaaaatcagtaccgcgtctggcccaatgaaatgccagcagatttgcacaaaattcgtccacatcacccactaaaccgtaatcttgatcataactggcagcaggcactgacaaaaacctccagcgaacgtcgggtggcggtagacattgaactgggcggctggcaggaacaactgattctgaccctcaccagtgaagagggtgtcagcatcacgcatacgctggacgggcagttcgacgaagccaataacgccgaaaaagcaatgaacaatctgaaggatggtctggcaaaactggggcaaaccctctattacgcccgcgatgtgcaaattaatttgccgggggcgctgtttgtaccaaacagtctgttaaaccagttccgccgtgaagctgctgacatgctggatgctgcgcgtcttgccagttaccagcgcggcagccgtaaaccggttgctgatcctgcgccggtttatccgcaaacgcatctgagtttcctcgcgaacgtatacaaccagaaagcgcgtgaattttatcatcgctatggtgtgcagctgattgacgcggcgtatgaagcacatgaagagaagggcgaagtcccggtgatgatcaccaagcattgtctgcgctttgcctttaatctgtgcccgaaacaggcgaaaggcaatatcaaaagctggaaggcgacgccaatgcaactggttaacggcgatgaagtattaacgctaaagtttgattgccgcccatgcgagatgcacgtcattggcaaaatcaaaaatcacatactgaaaatgccgttaccgggaagcgtagtggcatccgtaagtccggatgagctgctgaaaacattgcctaagcgaaaagggtaaaacgccagttttctggttactcacaactcattgaatctgcatgatattgcctgccgggtaaggcgtcacgccgcatccggcaacaaatgactcaacgttgtcccgcttctggtttgcgcgatttttgccagtaaaaatgctcgcgcaaaccttccgccgactcttccgccacagcacgcaattcatcgctgtccgcttcatgacgcagctgatgatccacattctttacccacacaaattcatgtcctttgtgccctgccatgagttgtcctgagaacagcgcacacgttaataagacaaccgataacgccttcgtaaacatcctgccacctttttcttaccttttgccgctatgatgccgatcgtttcttgaggttattattcagttttgcaaattagcgcaaagaaattctggaatcttccttcctgattttgcatggcattctgccgttgcggcgatttagtgctattttcgagcaaattacacacggaggtaaacactaatgtttactttgttgatatactcagcggcagggaggcgatgtgaaacaaagcgagttcagacgttggctcgaatctcagggcgtcgatgtagcgaatggcagcaaccatttgaaactcaggtttcatgggaggcgcagtgtcatgccgcgtcacccctgcgatgagattaaagaaccattgcgtaaagcaatcctgaaacaactcggtttgagttaatcgccaattaaaaaggttaatgacatgcgagggacagtcgaaattatgcgttatcccgtcactcttacacccgcgccggaaggcggttatatggtttcttttgtggatatccctgaagcgttgacgcagggcgaaactgtcgctgaagcgatggaagcggcaaaagatgctttactgaccgcatttgatttttattttgaagataacgagcttatccctttaccttcgccattaaatagtcatgatcactttattgaagtgcctttgagcgtcgcctctaaggtattgctgttaaatgcttttttacagtcagaaatcactcagcaagagttagccaggcgaattggcaaacctaaacaggagattactcgcctatttaacttgcatcatgcgacaaaaatcgacgccgtccagctcgcggcaaaggcgcttggcaaagagttatcgctggtgatggtttaattacagttaacgaaaagttgtcatttttaacaactgatatagactgccgaatcatctgcacataattacgattcgataatgaaaaaataccagcagcttgcagaacaattacgcgagcagattgcgtcgggtatctggcaacccggcgatcgtttgccttcgttgcgtgaccaggtggcgctttcaggcatgagctttatgactgtcagccatgcctatcagttgctcgaaagtcagggatatattatcgcacgaccgcagtcgggttattacgttgcgccacaggcaataaaaatgccgaaagcgccagtcattccagtcactcgagatgaagcagtcgatatcaacacttatatttttgatatgttgcaggccagtcgcgatccgtcggtcgttccgtttgcctcggcctttcccgacccgcgacttttccccctccaacaactaaaccgctcgctggcgcaggtaagcaaaaccgccacagcgatgagcgtgattgaaaacttaccgccaggaaacgcagaactgcgtcaggctattgctcgtcgctatgccttacagggcatcaccatttctcctgatgaaattgtcattactgccggggcgttagaggcattaaacctcagtttgcaagcggtaactgaaccgggcgattgggtgatagtagagaatccttgtttctacggtgcgttgcaggcgctggagcggctacggctgaaggcgttatcggtggcgacggatgttaaagaagggatagatcttcaggcgctggaactggcgttgcaggagtatccggtgaaagcgtgctggctgatgactaatagccagaatccactcggatttaccttaacgccgcaaaaaaaagcacaactggtggcgttgctcaatcagtacaacgtaacgctgattgaagatgacgtttacagcgaactttattttggacgggaaaaactgctgcctgcgaaagcgtgggatcgccacgatggcgttttgcattgctcttcgttttcgaaatgtctggtgcctggttttcgtattggttgggtcgccgccggaaaacatgcacgtaaaattcaacgcttgcagttgatgagtacgctttccaccagctcaccgatgcaacttgcgctggtggattacctttccacgcgccgatacgacgcccatcttcgtcgcctgcgtcgccagcttgcggaacgtaaacaacgtgcctggcaggcactgctgcgttatctgcctgcggaagtgaaaattcatcataatgacagtggttactttctctggctggagctccccgagccgttagatgccggcgaattaagcctggcggcactgacgcatcatatcagtattgcgccgggtaaaatgttttctaccggtgaaaactggtcacgttttttccgttttaataccgcgtggcagtggggagagcgtgaagaacaggcggtaaaacaattaggcaaacttattcaagaacggctgtaatagcgtttaatttaattcctcttagattgggtaatatgaatttcgaatagcagtcatatttcctaactccttgactatactccagaagataaccttacagacggcataatgcgcggtagctcacaacctgattaaattttctcaggggcgaaggtgtgcctgcaagccgccgtctatggttaaacaaggagatatttttacggcacggcggctgaacaattaattacgacaggagtaagaccttatgagcaagacatttgcccgcagcagcctgtgtgcgctcagcatgacaataatgaccgctcacgccgccgaaccgcctaccaatttagataaaccggaagggcgactggatattatcgcctggccgggatacatcgaacgcggacaaactgataaacaatacgactgggtaacgcagttcgaaaaagagacaggctgcgcggtgaatgtgaaaaccgccgcgacttccgatgaaatggtcagtctgatgaccaaagggggttacgatctggttacggcatccggcgatgcctcgctgcgtttgattatgggtaaacgcgtgcagccgattaataccgcattgattcccaactggaaaacgctcgatccgcgcgtggttaaaggcgactggtttaatgttggcggcaaagtttacggcacaccttaccaatgggggccgaacctgctgatgtacaacactaaaaccttcccgacgccgccggatagctggcaagtggtttttgttgagcaaaatctgccggacggcaagagcaataaaggccgcgttcaggcttatgatggccctatctacattgcggacgctgcgttgttcgttaaagccactcagccgcagttgggcatcagcgatccgtatcaactcaccgaagaacagtaccaggcggtgctgaaagtgctgcgcgctcaacacagtttgatccatcgctactggcatgacaataccgtgcaaatgagcgatttcaaaaacgagggtgtggttgcttccagtgcctggccctatcaggccaacgccctgaaagccgaaggccagcctgttgctaccgttttcccgaaggagggtgttaccggttgggctgataccaccatgctgcatagcgaagcgaaacatccggtttgcgcctacaaatggatgaactggtcattaacgccaaaagtgcagggcgatgtggcggcctggtttggctcgttaccggtagtgccggaagggtgtaaagccagtccgttattaggcgaaaaaggttgtgaaaccaacggttttaactatttcgacaaaatcgccttctggaaaacgcctatagcagaagggggcaagtttgttccctacagtcgctggacgcaggattacattgccattatgggcggtcgctaacttcgctggggtgctttatgacgtacgcagtggagtttgacaacgtctcgcggttgtacggtgacgtgcgcgcagtagatggcgtcagtattgcgataaaagatggtgagttcttctctatgctggggccgtccggctccggcaaaaccacctgcctgcgcctgattgctggcttcgaacagctttccggcggggctatctctatctttggtaaacccgccagcaatctgccaccgtgggagcgggacgtgaatactgtctttcaggactacgcgctatttccgcatatgtcgattcttgacaatgtcgcctatgggctgatggtcaaaggcgtgaataaaaagcagcggcacgcaatggcgcaagaggcgctggagaaagtggcgttggggtttgtacatcaacgtaaaccgtcacaactttctggtggtcagcgccagcgggttgctatcgccagagcattggtgaatgaaccgcgcgtattgctgttggatgaaccgctcggcgcactggatctcaaattgcgtgagcagatgcagctggaactgaaaaaactgcaacagtctctcggtatcacttttatcttcgttacccacgatcagggcgaagcgttatcgatgtccgatcgtgtggcggttttcaataatggacgcattgagcaggtcgattccccgcgcgatctctatatgcgcccgcgcacgccgtttgttgccggattcgtcgggacatccaacgtttttgatccgctaatggccgagaatctttgcggcatgacgggaagcttcgccctgcgaccggaacatatccgtctcaatatccccggcgaaatgcaggctaatggcacgatccaggcggtgcaatatcagggcgcagcgacccgttttgaactgacactgagcggcggtgaaaaactgctggtgagtcaggccaatatgacaggcgaagaactgcctgccacgctcacgcccggacaacaggtgatggtttcctggtcgcgtgatgtgatggtgccgctggttgaggagaggtgaatggcgatgaatgtattgcaatcaccttcacgtccaggtctgggtaaggtgtccggtttcttctggcgtaatccggggctggggctgtttttactgctgcttggcccgctaatgtggtttggcattgtctatttcggctcgctgctgacactgttatggcagggattttatacttttgacgatttcaccatgtcggtaacgccggaactgacgctggcgaatatccgtgcgctgtttaatccggcgaattacgacatcattctccgcacgctgactatggctgtggcagtcactatcgccagcgccattctggcttttccaatggcgtggtatatggcgcgctataccagcgggaaaatgaaagcgtttttttatattgcggtaatgttgccgatgtgggcgagctacattgttaaagcctatgcctggacgttattgctggcaaaagatggcgtggctcagtggtttttacaacatcttgggctggaaccactgctgactgcgttccttacattacctgcggtgggcggaaatacgctgtcaacttccgggctggggcgctttctggtgtttctctatatctggttgccgttcatgatcctgcccgttcaggcggcgcttgagcgtttgccgccgtcattgttgcaggcgtcggctgatctcggcgcacgtccacgacaaacctttcgctatgtggtgctgccgctggcaatcccgggtattgccgctggctctatctttaccttctcactcacactgggcgattttatcgtcccgcagctggttggtcctccaggatattttatcggcaatatggtttattcccagcagggggcgattggcaatatgccgatggcggcggcattcaccctggtgccgattattctcatcgcactgtacctggcgttcgtgaaacgtctgggagcgttcgatgcactctgaacgcgcaccgtttttcctcaaactggcggcctggggcggcgttgttttcctacattttcccatcctgataatcgccgcctatgcgtttaacactgaagatgcggcgtttagttttccaccgcagggcctgacgctgcgctggtttagcgtggcagcacagcgtagtgatattcttgatgccgtgacactgtcacttaaagtggcggcgctggcgacattaattgcgctggtgttagggacgctggcagctgccgcgctgtggcgacgagactttttcggcaaaaacgccatttcgctgttactgctgctgcccattgcgctgccgggcattgtcactggtctggcgttattaaccgcctttaaaaccatcaatctggagccgggatttttcaccatcgtggtcggtcatgcgactttttgtgtagttgtggtgtttaacaatgtcatcgcccgttttcgccgcacctcctggagtctggttgaggcgtcaatggatcttggggccaatggctggcaaaccttccgctacgtagtgttgccgaatctcagttcggcgttactggcaggaggaatgctggcgtttgccttgtcgttcgatgaaatcatcgttacgacctttacggcaggtcatgaacgaacgttaccgttgtggttgctcaatcagcttgggcgaccgcgtgatgtaccggtaactaacgtggtggcactgctggttatgttggtaacaaccttgccgatcctgggggcctggtggctaacccgcgaaggcgacaatggtcaataaccactgatacaggaatatgctatgcaacataagttactgattaacggagaactggttagcggcgaaggggaaaaacagcctgtctataatccggcaacgggggacgttttactggaaattgccgaggcatccgcagagcaggtcgatgctgctgtgcgcgcggcagatgcagcatttgccgaatgggggcaaaccacgccgaaagtgcgtgcggaatgtctgctgaaactggctgatgttatcgaagaaaatggtcaggtttttgccgaactggagtcccgtaattgtggcaaaccgctgcatagtgcgttcaatgatgaaatcccggcgattgtcgatgtttttcgctttttcgcgggtgcggcgcgctgtctgaatggtctggcggcaggtgaatatcttgaaggtcatacttcgatgatccgtcgcgatccgttgggggtcgtggcttctatcgcaccgtggaattatccgctgatgatggccgcgtggaaacttgctccggcgctggcggcagggaactgcgtagtgcttaaaccatcagaaattaccccgctgaccgcgttgaagttggcagagctggcgaaagatatcttcccggcaggcgtgattaacatactgtttggcagaggcaaaacggtgggtgatccgctgaccggtcatcccaaagtgcggatggtgtcgctgacgggctctatcgctaccggcgagcacatcatcagccataccgcgtcgtccattaagcgtactcatatggaacttggtggcaaagcgccagtgattgtttttgatgatgcggatattgaagcagtggtcgaaggtgtacgtacatttggctattacaatgctggacaggattgtactgcggcttgtcggatctacgcgcaaaaaggcatttacgatacgctggtggaaaaactgggtgctgcggtggcaacgttaaaatctggtgcgccggatgacgagtctacggagcttggacctttaagctcgctggcgcatctcgaacgcgtcagcaaggcagtagaagaggcgaaagcgacagggcacatcaaagtgatcactggcggtgaaaagcgcaagggtaatggctattactatgcgccgacgctgctggctggcgcattacaggacgatgccatcgtgcaaaaagaggtatttggtccagtagtgagtgttacgctcttcgacaacgaagaacaggtggtgaactgggcgaatgacagccagtacggacttgcatcttcggtatggacgaaagatgtgggcagggcgcatcgcgtcagcgcacggctgcaatatggttgtacttgggtcaatacccatttcatgctggtaagtgaaatgccgcacggtggacagaaactttctggttacggcaaggatatgtcactttatgggctggaggattacaccgtcgtccgccacgtcatggttaaacattaaggataataggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctatctctgctctcactgccgtaaaacatggcaactgcagttcacttacaccgcttctcaacccggtacgcaccagaaaatcattgatatggccatgaatggcgttggatgccgggcaactgcccgcattatgggcgttggcctcaacacgattttacgtcacttaaaaaactcaggccgcagtcggtaacctcgcgcatacagccgggcagtgacgtcatcgtctgcgcggaaatggacgaacagtggggctatgtcggggctaaatcgcgccagcgctggctgttttacgcgtatgacagtctccggaagacggttgttgcgcacgtattcggtgagcgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataagttggagtcattaccaagaaaatccgcaataatactcattctgaagatgaataagggcaagttgctgtttgatgattttttctcaaactggtgaaaaaacttgatgcacgtcaaaaaatgacgcatatttgcgcgcgttttattcatctggctggacgcccgtacatgtctctctatcaacacatgcttgttttttatgcggttatggcagcaatcgcatttcttatcacctggtttctttctcacgataagaaacgcatccgtttcttaagcgcctttctggtgggggcaacatggccgatgagtttcccggtggcgctgttgttttcactgttttaaatcttactcactggcttgacggcaccacgcagacttatatcatttggatgaatcgataaatttcacaagtggctaaggagaaagtatgtcgcatctggatgaagtcatcgcgcgcgtggatgccgcgattgaagagagcgtcattgcccatatgaacgaattattaatcgccctgagcgatgacgcggagttaagtcgggaagatcgctacacccagcagcagcgtttgcgcaccgctattgctcatcacggtcgcaagcataaagaagatatggaagcgcgccacgaacagttaaccaaaggcggcaccatcctctgattaaaatgagcgtctggctaccaaccaggcgccaaccacaagtaaaattgcgccacaaattgggccgaacaacgcccgtagtggtacgccatgactgcggaagatatccagcatcagaccgccaattagctggctggcgaccagtactgcaatagttgtcgccgctcccacattctgatatccgctgatactggcgaagacaaaaaacgatcccagcaagccgggtataagtgtccaccagcgcacgctggacaccagttcgccaaaccccgccatgccttgtttaaaccataaaatagaaacaaagagcacaatccccaccagtgagttcagcaacatggcgatgagaatggtagaggaggtctgggtgatgcgcaccatcagcgtgttctggactaccagaccaattccggcggcaatcaaaaaagcaagggtgagcgactgattcatccgatcgcgtccggttcagtgcgttcgtcgagttgcaactgcataaatgtcagatccagccagcgcccaaatttagtgcccacctgcggcatttgtgcggtgacgacaaatcccagcgaatggtgcagatgcagcgaggcctgattttgcgattcgatcccggcgaccatgacatgcttcccgcaatcccgcgcttcatcaatcaatcggcttaacaatttacgccccagacctttgccctgatgatcgggatggacataaaccgaatgttccacggtatggcgaaaaccatcgaaactacgccagtcgccaaacgaggcatatcccgtcactacgccatcttcttcacttaccagcaccggataacctgctatggtccgcgcttcaaaccaggcaatgcggttatctgcatcaaccgtttggtcattccagatagccgccgtatacaacacggcgtggttataaatttccgcaatggcagcacaatcggctttgcgggcaaaacggatggacatgtctggcctcgataaaataatgatgatgatgttatcaatactatcgaaaacagcccgaagcaacggattcctcgatgaaattattgcgtgttgcagaggggatgtgacggctgcaaacaaaaccaatcccgtgagcctgctactattgatggattcatgccaaaagcacaggagagcattatggggcaacaaaagcagcgtaatcgacgttgggttctggcctcgcgtccacatggcgcaccggttccggagaatttccgtcttgaagaagatgatgtcgccacaccgggtgaaggacaggtgttactgcgcacagtttatttgtccctggacccgtatatgcgtggacgtatgagcgatgagccatcttattcaccgcctgttgatattggcggcgtgatggtcggcggcacggtgagccgtgttgtggagtcgaatcatcctgattatcagcctggcgactgggtgctgggctacagtggatggcaggactatgacatatccagtggtgatgatctggtgaaacttggcgatcatccgcaaaatccatcgtggtcgctgggtgtgctggggatgccaggctttaccgcttatatggggctgctggatatcggtcagcctaaagagggcgaaacgttggtggtagctgcggcgacaggtcctgtgggagcaacggtggggcaaatcggcaaacttaaaggttgcagggtggtgggggttgccggtggcgcggaaaaatgccgccatgctatcgaggtgctgggcttcgatgtttgtcttgatcaccacgcggatgattttgccgaacaactggcgaaagcgtgcccaaaaggtattgatatctattatgaaaacgtgggcggtaaggtatttgatgcagtgctaccattacttaatacatctgcgcgcattcccgtttgtggcttagtgagcagctataacgctacagagctaccacccggtccggatcgtttacccctgttgatggcaacggtgctgaaaaaacgtattcgcttgcaagggtttattatcgctcaggattatggtcaccgcatccatgagtttcagaaggagatggggcaatgggtgaaagaggataaaatccactaccgcgaagatattactgatggtttagagaatgcgccacagacgtttatcggcctgctgaagggtaaaaacttcggcaaagtggtgatccgcgtggcgggtgatgattaaagtttcaacggcggcgtaagccgccataaaaatccaggcaaaaagcttattttcagctttaattaactaaccacgtcattgttctgctgctaataacaacaaaggtgagtggtttatgattattcactttaatacaccaggtgaactccttctgccatgcaggcagggttggacagaaaacacgcgaaggaattaaaatgcctggaacgggaaaaatgaaacatgtcagtttgactctgcaggttgagaacgacctgaaacatcagcttagtattggcgcattaaaacctggcgcacgcctgattactaaaaatctggcggagcaattaggtatgagtattacacctgtgcgtgaagcattattacgtctggtttcggtgaatgcgctttctgtcgcacctgcacaagcatttacagttccggaagtggggaaacgtcaattagacgaaatcaatcggatccgctacgaactggaattaatggcagttgctctggctgttgaaaacctcaccccgcaagaccttgcggaactccaggaattgctcgagaaattacagcaggcgcaagaaaagggcgacatggaacaaatcattaatgtaaacaggctatttcgcttagcgatttatcatcgctcaaatatgcccatcctgtgtgagatgattgagcaactgtgggtcaggatggggcctggtttacattatctctatgaagcgattaatccagcggaattacgggagcatatagaaaactatcatctgttactcgctgcgttaaaagcaaaagacaaagagggatgcagacattgtcttgctgaaattatgcaacaaaatattgctattttataccagcaatacaatcgttaaagtaaatgcccggcaaataccgggcatcaaggtaattactcaaatcgccatgcgatattcacgccgacaccataatttcgcccgggcgcaggttcgtaatatcgcccgtttgactcattgacaatgacagaaccaacgtattctttatcgaataaattatcgacacgaccaaataaatccacagttaaattgtggtaattgtatttatacccggtgaataagccgatgagagtataagacggcgccttggccgtattttcatcatctgccataatatcgcccatataacgcgcttccgtgcctgcataccagccatcttccggtacataacctatcgacgcaaagcccatattacgggcgatcccaggcatccgattaccgttacaatcctgttcattgcaaacattgctgcgataggtcgcatcaagccaggtccaggacgcgtttacgcgaaaatctcccgcgaaacgttgatcccatgccagttcagcgccttgacgacgggtctttccagcatttttgtaagtcgtacgcccaccgctactgctatcgacaacaatttcatcatcggtgtcggtctggaacaatgcgagactaagcagcccatcaccaatacgcgttttactgccgatctcaattgtatcgttggtggatggttttaaaccaaagttcataccgctttgcccatcagcccgataagacagctcattaatcgtcggcgtttcaaaaccacgcccggctgccagatagatattccaggcatcggtcattgcatattttaacgatccggctggtagccatttgtgataactggcatcaccgctgtcatcgccgttacccggagtaatgtaatggtcgttggaatcaaaccacacggagctgtagcgcacgccagcatccagcgacagtttttcgctcagctgccactgcgtctgtaaatagggatcgatgttccacatcagattgcgttcgtcgcgacgcaactcacctttttgcccgtactccggcatgccgctattcaggcggaagttattgtagcccttgcggttttcactcatgttttcgtagttcaggccggtagtgaacgtgaccggaacgcccagttcaccacggtgtgtccagcggctgtctattccctggtaatggcgttgcagggtaatcacgccgcccgcatgtgacgggttaagttgtggtgccatgggtattgactggtactgggtcgtttctcgctctccggcatacatcatcacactcatatcatcccgcgaactcaggctacgttcatagcgcaacccagcctgagtttgcttgatggtttttcgcgtgtcgtattgttcagcgcgtggcgcttgttgcggattcgctttccattctgctttggttagcccaccagggtcatctgctttgatatccacgctattgaaaatcaggcttaatttgctggcgtcatcaatgcgtacgccaagtttggcattagctaaatttttctgtgcgccactatggtcacgatagccgtgggtcgtaaaacgcgtggttgagacggtgtaatcgacatcgccgggctgtgtgccgtcgcccgttgcacccgttgctttgagcccatagcgccagctgccaaaactgccgtagtaactgctggcttcaatggttggtggctgttgcccggtctgggtggtgacattcattacaccgccagacgcgttgccatacagggcagagaaggggccacgcagcacttccacattttgcacactgcttaaatcgatgttggatgtttgcccttgcccgtcgggcatggtagcgggaataccgtccacatacaggcgaataccgcgaattccgtaagtggagcgggagccaaatccgcgaatcgacagctgtaaatcttgcgcatagttctgccgattttgtacctgcaaaccaggcacgctggtcagtgattcggacaagttaatgcgcggtgttgccaggcgcatctcctcgccatccaccacgcttactgctgctggggtatccagttctgaaaccacctgcggtgcggcactgacaatcatggtctgttcatcagcggcaaaaacaacgggggaaagggcaagtagtgcgggcaaaacggtctgtcggacggaaaaaatcttcatgaaaaaagccaggttaagaatgggaaaacgccgttatggtaatgaaattgtaaatttatggaaaatgaaacggcacgatacgttaagtaattgagaaaattgtagtcgtaacggcaagaaatgctccacatttgagaaaataatgattaccattcccatttataacaagagcgtaacgatgattacgcttagcgaagcattgtgaagcagcaaaaatatcggttcatcaaagggagtcgtcatgcatttacgtcatctgttttcatcgcgcctgcgtggttcattactgttaggttcattgcttgttgcttcatcattcagtacgcaggccgcagaagaaatgctgcgtaaagcggtaggtaaaggtgcctacgaaatggcttatagccagcaagaaaacgcactgtggctcgccacttcgcaaagccgcaaactggataaaggtggcgtggtttatcgtcttgatccggtcactctggaagtgacgcaggcgatccataacgatctcaagccgtatggtgccaccatcaataacacgactcagacgttgtggtttggtaacaccgtaaacagcgcggtcacggcgatagatgccaaaacgggcgaagtgaaaggccgtctggtgctggatgatcgtaagcgcacggaagaggtgcgcccgctgcaaccgcgtgagctggtagctgatgatgccacgaacaccgtttacatcagtggtattggtaaagagagcgtgatttgggtcgttgatggcgagaatatcaaactgaaaaccgccatccagaacaccggtaaaatgagtaccggtctggcgctggatagcaaaggcaaacgtctttacaccactaacgctgacggcgaattgattaccatcgacaccgccgacaataaaatcctcagccgtaaaaagctgctggatgacggcaaagagcacttctttatcaacattagccttgatatcgccaggcagcgtgcatttatcaccgattctaaagcggcagaagtgttagtggtcgatacccgtaatggcaatattctggcgaaggttgcggcaccggaatcactggctgtgctgtttaacccagcgcgtaatgaagcctacgtaacgcatcgtcaggcaggtaaagtcagtgtgattgacgcgaaaagctataaagtggtgaaaacgttcgatacgccgactcatccgaacagcctggcgctgtctgccgatggcaaaacgctgtatgtcagtgtaaaacaaaaatccactaaacagcaggaagctacccagccggacgatgtgattcgtattgcgctgtaatagatatggcgagggtgaaaacggagagacttgcctgacttttatcacgccgcatgcggcacaccttcgtcagtaatttgaagttgcccggcacgtagccgggcaattttgcaattagctcgccgtttcaggcttaaacacgatttcctgtttttcttcatcttcctcgacgactggcgcagtgctgtgaatttcagcaacgcgtttgcgcacaccaaaccagcctataaccagcagaataccgataatcggcagcgccgcgatagtataagtcccgttcgggtaatcgaacgccatcagcacaaggacactcagtaaaaacagtaatgtcagccaggaagtgaagggcgcgccaggcagtttaaaactgacatccgctgctttgccttctttaatcgctttacgcaggcgcatctggcacacgatgataaacgcccatgaagcgatgattcccagcgacgcgaagttcaacacaatctcaaatacgcgcgacggcaccagatagttgaggaatacgccgacgacatacacaactagtgtcgctagaatcccggcatacggcacatgctgacgactcattttcgccataaaactcggtgcggaaccgcccatcgccattgagcgcagaatacgtccggtgcagtacagacctgagttcaggctggagagggcagcggtcagcaccacaatgttcataatgctgccgatatatggcacacccagtttagagaaaaacgtcacgaacggactttgccccgcctgatacgcgctccacggcaatagcataaccagcaacaccacggagccgacgtaaaacaggccaatacgccaaatcacgctgttaatcgctttaggcaccatggtctgcggatctttacattctccggcagctgtacccaccatttcaatggaggcaaaagcaaacactacgccctgaatcaacaccagagcaggcagcaaaccgtgggggaagaagccgccattatcggtaattaaatgaaagccagtggtgttgccatccagcggctgaccactaccgaggaacactgtacccacgaccaaaaaggtcacaatggcgagcactttaataagcgcaaaccagaactccatctccgcaaaccatttcacaccgatcatattcatggtgccaacgatggtaagtgcagcgagcgcaaagacccactgcggcacgccgccaaacgcaccccagtaatgcatatacagagcgacggcggtaatatcaacaatccccgtcatcgcccagttgatgaagtacatccagccagcaacataagcggctttctcacccaaaaactcacgggcataagagacaaaactgccactggaagggcggtgtagcaccagctcacccaatgcacgcagaataaaaaacgaaaacaagccacaaattaaataaaccagtgccaatgctggacccgccatttgcagtcgggctcctgcacctaaaaacaagccggtgccaatcgcgccgccaatggcgatcatctgtacctggcgattgcccatcgctttgtgatacccctcttcgtgggcattaagccagcggcgtttcgcggcgtgttgatctgaagtgtcggtgtcgtgtttactcattgctctccctgattgctttaatgaaaaagtcatataagttgccatgaacaatgtttattcatcctggcgatgatagttatcaccattattctttatgggtataaaactatcggcgcagcatcctacccgttatcgataaacgatgcaaaacatccccttacaatcctgaaggggaataatacaactgacgaaaaaatgacaaatctttttgctggttaacctgtgtactgtcctacacttaatctttaaaagattgtgagggcatatgattaaggtgtatggtgtacccggatggggctctacaatcagtgagctgatgctaacactggctgatattccttatcagttcgttgatgtcagtggttttgaccacgagggagcttcacgcgagttattgaaaaccctgaacccgttgtgtcaggttccgacactggcgctggaaaatgacgagattatgacggagacagcggcgattgcatttatggttctcgatcgtcgcccggaccttgcgccaccggttgggcgcgccgaacgtcagcagtttcaacggctattggtctggctggttgctaatgtctatccaacattcactttcgccgattaccctgagcgttgggcatctgacgcacctgaacagttaaagaagaatgtaattgaatatcgcaaatcactttatatctggctgaattcacaattgaccgctgaaccttatgcctttggtgagcaactaacgctggtggactgttatctctgcaccatgcgcacatgggggccggggcatgaatggtttcaggataatgcgcagaatatcagcgcgatcgctgatgctgtatgtcagttaccgaaattacaagaagtattaaaaaggaatgaaattatttgagtgggatacca
